United States Patent 11,596,686 (CORONAVIRUS VACCINE) - sequence listing, part 8

SEQ ID NO: 11453 - protein, 1301 aa, synthetic construct
  REGION 1..1301: note = SARS-CoV-2/Congo/94/2020__EPI_ISL_417947 spike protein (1-1147)(F970C_G999C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDILFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNCGAISSVLNDILSRLDKVEAEVQIDRLITCRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11454 - protein, 1301 aa, synthetic construct
  REGION 1..1301: note = SARS-CoV-2/Congo/158/2020__EPI_ISL_417950 spike protein (1-1147)(F970C_G999C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNCGAISSVLNDILSRLDKVEAEVQIDRLITCRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFLSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11455 - protein, 1301 aa, synthetic construct
  REGION 1..1301: note = SARS-CoV-2/USA/UT-00034/2020__EPI_ISL_417977 spike protein (1-1147)(F970C_G999C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYYKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNCGAISSVLNDILSRLDKVEAEVQIDRLITCRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11456 - protein, 1301 aa, synthetic construct
  REGION 1..1301: note = SARS-CoV-2/USA/UT-00033/2020__EPI_ISL_417976 spike protein (1-1147)(F970C_G999C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGLTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNCGAISSVLNDILSRLDKVEAEVQIDRLITCRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11457 - protein, 1301 aa, synthetic construct
  REGION 1..1301: note = SARS-CoV-2/USA/WI-13/2020__EPI_ISL_417516 spike protein (1-1147)(F970C_G999C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVLPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNCGAISSVLNDILSRLDKVEAEVQIDRLITCRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11458 - protein, 1300 aa, synthetic construct
  REGION 1..1300: note = SARS-CoV-2/India/1-27/2020__EPI_ISL_413522 spike protein (1-1146)(F969C_G998C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVIQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNCGAISSVLNDILSRLDKVEAEVQIDRLITCRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11459 - protein, 1295 aa, synthetic construct
  REGION 1..1295: note = SARS-CoV-2/pangolin/Guangxi/P4L/2017__EPI_ISL_410538 spike protein (1-1141)(F964C_G993C) WhcAg construct
MFVFLFVLPLVSSQCVNLTTRTGIPPGYTNSSTRGVYYPDKVFRSSILHLTQDLFLPFFSNVTWFNTINYQGGFKKFDNPVLPFNDGVYFASTEKSNIIRGWIFGTTLDARTQSLLIVNNATNVVIKVCEFQFCTDPFLGVYYHNNNKTWVENEFRVYSSANNCTFEYISQPFLMDLEGKQGNFKNLREFVFKNVDGYFKIYSKHTPIDLVRDLPRGFAALEPLVDLPIGINITRFQTLLALHRSYLTPGNLESGWTTGAAAYYVGYLQQRTFLLSYNQNGTITDAVDCSLDPLSETKCTLKSLTVEKGIYQTSNFRVQPTISIVRFPNITNLCPFGEVFNASKFASVYAWNRKRISNCVADYSVLYNSTSFSTFKCYGVSPTKLNDLCFTNVYADSFVVKGDEVRQIAPGQTGVIADYNYKLPDDFTGCVIAWNSVKQDALTGGNYGYLYRLFRKSKLKPFERDISTEIYQAGSTPCNGQVGLNCYYPLERYGFHPTTGVNYQPFRVVVLSFELLNGPATVCGPKLSTTLVKDKCVNFNFNGLTGTGVLTTSKKQFLPFQQFGRDISDTTDAVRDPQTLEILDITPCSFGGVSVITPGTNTSNQVAVLYQDVNCTEVPMAIHAEQLTPAWRVYSAGANVFQTRAGCLVGAEHVNNSYECDIPVGAGICASYHSMSSLRSVNQRSIIAYTMSLGAENSVAYSNNSIAIPTNFTISVTTEILPVSMTKTSVDCTMYICGDSIECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNCGAISSVLNDILSRLDKVEAEVQIDRLITCRLQSLQTYVTQQLIRAAEIRASANLAATKMSECVLGQSKRVDFCGKGYHLMSFPQSAPHGVVFLHVTYVPAQEKNFTTAPAICHEGKAHFPREGVFVSNGTHWFITQRNFYEPQIITTDNTFVSGSCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11460 - protein, 1295 aa, synthetic construct
  REGION 1..1295: note = SARS-CoV-2/pangolin/Guangxi/P5L/2017__EPI_ISL_410540 spike protein (1-1141)(F964C_G993C) WhcAg construct
MFVFLFVLPLVSSQCVNLTTRTGIPPGYTNSSTRGVYYPDKVFRSSILHLTQDLFLPFFSNVTWFNTINYQGGFKKFDNPVLPFNDGVYFASTEKSNIIRGWIFGTTLDARTQSLLIVNNATNVVIKVCEFQFCTDPFLGVYYHNNNKTWVENEFRVYSSANNCTFEYISQPFLMDLEGKQGNFKNLREFVFKNVDGYFKIYSKHTPIDLVRDLPRGFAALEPLVDLPIGINITRFQTLLALHRSYLTPGKLESGWTTGAAAYYVGYLQQRTFLLSYNQNGTITDAVDCSLDPLSETKCTLKSLTVEKGIYQTSNFRVQPTISIVRFPNITNLCPFGEVFNASKFASVYAWNRKRISNCVADYSVLYNSTSFSTFKCYGVSPTKLNDLCFTNVYADSFVVKGDEVRQIAPGQTGVIADYNYKLPDDFTGCVIAWNSVKQDALTGGNYGYLYRLFRKSKLKPFERDISTEIYQAGSTPCNGQVGLNCYYPLERYGFHPTTGVNYQPFRVVVLSFELLNGPATVCGPKLSTTLVKDKCVNFNFNGLTGTGVLTTSKKQFLPFQQFGRDISDTTDAVRDPQTLEILDITPCSFGGVSVITPGTNTSNQVAVLYQDVNCTEVPMAIHAEQLTPAWRVYSAGANVFQTRAGCLVGAEHVNNSYECDIPVGAGICASYHSMSSFRSVNQRSIIAYTMSLGAENSVAYSNNSIAIPTNFTISVTTEILPVSMTKTSVDCTMYICGDSIECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNCGAISSVLNDILSRLDKVEAEVQIDRLITCRLQSLQTYVTQQLIRAAEIRASANLAATKMSECVLGQSKRVDFCGKGYHLMSFPQSAPHGVVFLHVTYVPAQEKNFTTAPAICHEGKAHFPREGVFVSNGTHWFITQRNFYEPQIITTDNTFVSGSCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11461 - protein, 1295 aa, synthetic construct
  REGION 1..1295: note = SARS-CoV-2/pangolin/Guangxi/P5E/2017__EPI_ISL_410541 spike protein (1-1141)(F964C_G993C) WhcAg construct
MFVFLFVLPLVSSQCVNLTTRTGIPPGYTNSSTRGVYYPDKVFRSSILHLTQDLFLPFFSNVTWFNTITYQGGSKKFDNPVLPFNDGVYFASTEKSNIIRGWIFGTTLDARTQSLLIVNNATNVVIKVCEFQFCTDPFLGVYYHNNNKTWVENEFRVYSSANNCTFEYISQPFLMDLEGKQGNFKNLREFVFKNVDGYFKIYSKHTPIDLVRDLPRGFAALEPLVDLPIGINITRFQTLLALHRSYLTPGKLESGWTTGAAAYYVGYLQQRTFLLSYNQNGTITDAVDCSLDPLSETKCTLKSLTVEKGIYQTSNFRVQPTISIVRFPNITNLCPFGEVFNASKFASVYAWNRKRISNCVADYSVLYNSTSFSTFKCYGVSPTKLNDLCFTNVYADSFVVKGDEVRQIAPGQTGVIADYNYKLPDDFTGCVIAWNSVKQDALTGDNYGYLYRLFRKSKLKPFERDISTEIYQAGSTPCNGQVGLNCYYPLERYGFHPTTGVNYQPFRVVVLSFELLNGPATVCGPKLSTTLVKDKCVNFNFNGLTGTGVLTTSKKQFLPFQQFGRDISDTTDAVRDPQTLEILDITPCSFGGVSVITPGTNTSNQVAVLYQDVNCTEVPMAIHAEQLTPAWRVYSAGANVFQTRAGCLVGAEHVNNSYECDIPVGAGICASYHSMSSFRSVNQRSIIAYTMSLGAENSVAYSNNSIAIPTNFTISVTTEILPVSMTKTSVDCTMYICGDSIECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNCGAISSVLNDILSRLDKVEAEVQIDRLITCRLQSLQTYVTQQLIRAAEIRASANLAATKMSECVLGQSKRVDFCGKGYHLMSFPQSAPHGVVFLHVTYVPAQEKNFTTAPAICHEGKAHFPREGVFVSNGTHWFITQRNFYEPQIITTDNTFVSGSCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11462 - protein, 1293 aa, synthetic construct
  REGION 1..1293: note = SARS-CoV-2/pangolin/Guangxi/P1E/2017__EPI_ISL_410539 spike protein (1-1139)(F962C_G991C) WhcAg construct
MFVFLFVLPLVSSQCVNLTTRTGIQPGYTNSSTRGVYYPDKVFRSSILHLTQDLFLPFFSNVTWFNTINYQGGFKKFDNPVLPFNDGVYFASTEKSNIIRGWIFGTTLDARTQSLLIVNNATNVVIKVCEFQFCTDPFLGVYYHNNNKTWVENEFRVYSSANNCTFEYISQPFLMDLEGKQGNFKNLREFVFKNVDGYFKIYSKHTPIDLVRDLPRGFAALEPLVDLPIGINITRFQTLLALHRSYLTPGKLESGWTTGAAAYYVGYLQQRTFLLSYNQNGTITDAVDCSLDPLSETKCTLKSLTVEKGIYQTSNFRVQPTISIVRFPNITNLCPFGEVFNASKFASVYAWNRKRISNCVADYSVLYNSTSFSTFKCYGVSPTKLNDLCFTNVYADSFVVKGDEVRQIAPGQTGVIADYNYKLPDDFTGCVIAWNSVKQDALTGGNYLYRLFRKSKLKPFERDISTEIYQAGSTPCNGQVGLNCYYPLERYGFHPTTGVNYQPFRVVVLSFELLNGPATVCGPKLSTTLVKDKCVNFNFNGLTGTGVLTTSKKQFLPFQQFGRDISDTTDAVRDPQTLEILDITPCSFGGVSVITPGTNTSNQVAVLYQDVNCTEVPMAIHAEQLTPAWRVYSAGANVFQTRAGCLVGAEHVNNSYECDIPVGAGICASYHSMSSLRSVNQRSIIAYTMSLGAENSVAYSNNSIAIPTNFTISVTTEILPVSMTKTSVDCTMYICGDSIECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNCGAISSVLNDILSRLDKVEAEVQIDRLITCRLQSLQTYVTQQLIRAAEIRASANLAATKMSECVLGQSKRVDFCGKGYHLMSFPQSAPHGVVFLHVTYVPAQEKNFTTAPAICHEGKAHFPREGVFVSNGTHWFITQRNFYEPQIITTDNTFVSGSCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11463 - protein, 1301 aa, synthetic construct
  REGION 1..1301: note = SARS-CoV-2/Wuhan/WIV05/2019__EPI_ISL_402128 spike protein (1-1147)(A972C_R995C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGCISSVLNDILSRLDKVEAEVQIDCLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11464 - protein, 1297 aa, synthetic construct
  REGION 1..1297: note = SARS-CoV-2/bat/Yunnan/RaTG13/2013__EPI_ISL_402131 spike protein (1-1143)(A968C_R991C) WhcAg construct
MFVFLVLLPLVSSQCVNLTTRTQLPPAYTNSSTRGVYYPDKVFRSSVLHLTQDLFLPFFSNVTWFHAIHVSGTNGIKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPPGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTDSIVRFPNITNLCPFGEVFNATTFASVYAWNRKRISNCVADYSVLYNSTSFSTFKCYGVSPTKLNDLCFTNVYADSFVITGDEVRQIAPGQTGKIADYNYKLPDDFTGCVIAWNSKHIDAKEGGNFNYLYRLFRKANLKPFERDISTEIYQAGSKPCNGQTGLNCYYPLYRYGFYPTDGVGHQPYRVVVLSFELLNAPATVCGPKKSTNLVKNKCVNFNFNGLTGTGVLTESNKKFLPFQQFGRDIADTTDAVRDPQTLEILDITPCSFGGVSVITPGTNASNQVAVLYQDVNCTEVPVAIHADQLTPTWRVYSTGSNVFQTRAGCLIGAEHVNNSYECDIPIGAGICASYQTQTNSRSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGCISSVLNDILSRLDKVEAEVQIDCLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGSCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11465 - protein, 1301 aa, synthetic construct
  REGION 1..1301: note = SARS-CoV-2/Wuhan/HBCDC-HB-01/2019__EPI_ISL_402132 spike protein (1-1147)(A972C_R995C) WhcAg construct
MFVFLVLLPLVSSQCVNLTTRTQLPPAYTNSITRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGCISSVLNDILSRLDKVEAEVQIDCLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11466 - protein, 1301 aa, synthetic construct
  REGION 1..1301: note = SARS-CoV-2/Guangdong/20SF028/2020__EPI_ISL_403936 spike protein (1-1147)(A972C_R995C) WhcAg construct
MFVFLVLLPLVSSQCVNLTTRTQLPPAYTNSFTRGVYYPDKVFRSSVLYSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGCISSVLNDILSRLDKVEAEVQIDCLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11467 - protein, 1301 aa, synthetic construct
  REGION 1..1301: note = SARS-CoV-2/Shenzhen/SZTH-001/2020__EPI_ISL_406592 spike protein (1-1147)(A972C_R995C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGCISSVLNDILSRLDKVEAEVQIDCLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVLIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11468 - protein, 1301 aa, synthetic construct
  REGION 1..1301: note = SARS-CoV-2/Shenzhen/SZTH-004/2020__EPI_ISL_406595 spike protein (1-1147)(A972C_R995C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWDRKRISNCVAYYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGCISSVLNDILSRLDKVEAEVQIDCLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11469 - protein, 1301 aa, synthetic construct
  REGION 1..1301: note = SARS-CoV-2/France/IDF0372/2020__EPI_ISL_406596 spike protein (1-1147)(A972C_R995C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSFLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGCISSVLNDILSRLDKVEAEVQIDCLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11470 - protein, 1301 aa, synthetic construct
  REGION 1..1301: note = SARS-CoV-2/Australia/VIC01/2020__EPI_ISL_406844 spike protein (1-1147)(A972C_R995C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRRYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGCISSVLNDILSRLDKVEAEVQIDCLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11471 - protein, 1301 aa, synthetic construct
  REGION 1..1301: note = SARS-CoV-2/Germany/BavPat1/2020__EPI_ISL_406862 spike protein (1-1147)(A972C_R995C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGCISSVLNDILSRLDKVEAEVQIDCLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11472 - protein, 1301 aa, synthetic construct
  REGION 1..1301: note = SARS-CoV-2/Wuhan/HBCDC-HB-02/2020__EPI_ISL_412978 spike protein (1-1147)(A972C_R995C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNFLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGCISSVLNDILSRLDKVEAEVQIDCLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11473 - protein, 1301 aa, synthetic construct
  REGION 1..1301: note = SARS-CoV-2/Australia/QLD02/2020__EPI_ISL_407896 spike protein (1-1147)(A972C_R995C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGCISSVLNDILSRLDKVEAEVQIDCLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQLELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11474 - protein, 1301 aa, synthetic construct
  REGION 1..1301: note = SARS-CoV-2/India/1-31/2020__EPI_ISL_413523 spike protein (1-1147)(A972C_R995C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSVIGKIQDSLSSTASALGKLQDVVNQNAQALNTLVKQLSSNFGCISSVLNDILSRLDKVEAEVQIDCLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11475 - protein, 1301 aa, synthetic construct
  REGION 1..1301: note = SARS-CoV-2/Hong Kong/case42_VM20002493/2020__EPI_ISL_414527 spike protein (1-1147)(F970C_G999C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVREIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGCISSVLNDILSRLDKVEAEVQIDCLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11476 - protein, 1301 aa, synthetic construct
  REGION 1..1301: note = SARS-CoV-2/Sweden/01/2020__EPI_ISL_411951 spike protein (1-1147)(A972C_R995C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDCGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGCISSVLNDILSRLDKVEAEVQIDCLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11477 - protein, 1301 aa, synthetic construct
  REGION 1..1301: note = SARS-CoV-2/Hong Kong/case85_VM20002868/2020__EPI_ISL_414519 spike protein (1-1147)(F970C_G999C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDLNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGCISSVLNDILSRLDKVEAEVQIDCLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11478 - protein, 1301 aa, synthetic construct
  REGION 1..1301: note = SARS-CoV-2/Hong Kong/case42_VM20002493/2020__EPI_ISL_414527 spike protein (1-1147)(A972C_R995C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFAISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGCISSVLNDILSRLDKVEAEVQIDCLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11479 - protein, 1301 aa, synthetic construct
  REGION 1..1301: note = SARS-CoV-2/Australia/NSW09/2020__EPI_ISL_413595 spike protein (1-1147)(F970C_G999C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEVKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGCISSVLNDILSRLDKVEAEVQIDCLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11480 - protein, 1301 aa, synthetic construct
  REGION 1..1301: note = SARS-CoV-2/Hong Kong/case85_VM20002868/2020__EPI_ISL_414519 spike protein (1-1147)(A972C_R995C) WhcAg construct
MFVFLVLVPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGCISSVLNDILSRLDKVEAEVQIDCLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11481 - protein, 1301 aa, synthetic construct; identical to SEQ ID NO: 11471
  REGION 1..1301: note = SARS-CoV-2/England/200990660/2020__EPI_ISL_414523 spike protein (1-1147)(A972C_R995C) WhcAg construct

SEQ ID NO: 11482 - protein, 1301 aa, synthetic construct
  REGION 1..1301: note = SARS-CoV-2/Belgium/BA-02291/2020__EPI_ISL_415159 spike protein (1-1147)(F970C_G999C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSFTASALGKLQDVVNQNAQALNTLVKQLSSNFGCISSVLNDILSRLDKVEAEVQIDCLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11483 - protein, 1301 aa, synthetic construct; identical to SEQ ID NO: 11463
  REGION 1..1301: note = SARS-CoV-2/USA/WA8-UW5/2020__EPI_ISL_413486 spike protein (1-1147)(F970C_G999C) WhcAg construct

SEQ ID NO: 11484 - protein, 1301 aa, synthetic construct
  REGION 1..1301: note SARS-CoV-2/Switzerland/1000477797/2020__EPI_ISL_413023 spike protein (1-1147)(A972C_R995C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFNIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGCISSVLNDILSRLDKVEAEVQIDCLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11485 - protein, 1301 aa, synthetic construct
  REGION 1..1301: note = SARS-CoV-2/Belgium/BA-02291/2020__EPI_ISL_415159 spike protein (1-1147)(A972C_R995C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRRSNLKPFERDISTEIYQAGSTPCNGVEGFNCYFPLQSYGFQPTNGVGYQPYRVVVLSFELLPAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSAAPALGKLQDVVNQNAQALNTLVKQLSSNFGCISSVLNDILSRLDKVEAEVQIDCLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11486 - protein, 1301 aa, synthetic construct
  REGION 1..1301: note = SARS-CoV-2/USA/WA8-UW5/2020__EPI_ISL_413486 spike protein (1-1147)(A972C_R995C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEYVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGCISSVLNDILSRLDKVEAEVQIDCLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11487 - protein, 1301 aa, synthetic construct
  REGION 1..1301: note = SARS-CoV-2/England/20102000506/2020__EPI_ISL_415147 spike protein (1-1147)(A972C_R995C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGYCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGCISSVLNDILSRLDKVEAEVQIDCLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11488 - protein, 1301 aa, synthetic construct
  REGION 1..1301: note = SARS-CoV-2/Belgium/VAG-03013/2020__EPI_ISL_415155 spike protein (1-1147)(A972C_R995C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTATALGKLQDVVNQNAQALNTLVKQLSSNFGCISSVLNDILSRLDKVEAEVQIDCLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11489 - protein, 1301 aa, synthetic construct
  REGION 1..1301: note = SARS-CoV-2/Belgium/BC-03016/2020__EPI_ISL_415157 spike protein (1-1147)(A972C_R995C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTAPALGKLQDVVNQNAQALNTLVKQLSSNFGCISSVLNDILSRLDKVEAEVQIDCLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11490 - protein, 1301 aa, synthetic construct
  REGION 1..1301: note = SARS-CoV-2/Germany/BavPat3/2020__EPI_ISL_414521 spike protein (1-1147)(A972C_R995C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQQVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGCISSVLNDILSRLDKVEAEVQIDCLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11491 - protein, 1301 aa, synthetic construct
  REGION 1..1301: note = SARS-CoV-2/France/HF1805/2020__EPI_ISL_414628 spike protein (1-1147)(A972C_R995C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGCISSVLNDILSRLDKVEAEVQIDCLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGVVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11492 - protein, 1301 aa, synthetic construct
  REGION 1..1301: note SARS-CoV-2/Netherlands/ZuidHolland_9/2020__EPI_ISL_414445 spike protein (1-1147)(A972C_R995C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICVQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGCISSVLNDILSRLDKVEAEVQIDCLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11493 - protein, 1301 aa, synthetic construct
  REGION 1..1301: note = SARS-CoV-2/Finland/FIN03032020A/2020__EPI_ISL_413602 spike protein (1-1147)(A972C_R995C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVISWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGCISSVLNDILSRLDKVEAEVQIDCLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11494 - protein, 1301 aa, synthetic construct
  REGION 1..1301: note = SARS-CoV-2/France/GE1977/2020__EPI_ISL_414632 spike protein (1-1147)(A972C_R995C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLFSTASALGKLQDVVNQNAQALNTLVKQLSSNFGCISSVLNDILSRLDKVEAEVQIDCLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11495 - protein, 1301 aa, synthetic construct
  REGION 1..1301: note = SARS-CoV-2/Finland/FIN-313/2020__EPI_ISL_414641 spike protein (1-1147)(A972C_R995C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFKTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGCISSVLNDILSRLDKVEAEVQIDCLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11496 - protein, 1301 aa, synthetic construct
  REGION 1..1301: note SARS-CoV-2/Netherlands/ZuidHolland_2/2020__EPI_ISL_414556 spike protein (1-1147)(A972C_R995C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIALEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGCISSVLNDILSRLDKVEAEVQIDCLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11497 - protein, 1301 aa, synthetic construct
  REGION 1..1301: note = SARS-CoV-2/USA/WA-UW31/2020__EPI_ISL_414618 spike protein (1-1147)(A972C_R995C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGAEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGCISSVLNDILSRLDKVEAEVQIDCLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11498 - protein, 1301 aa, synthetic construct
  REGION 1..1301: note = SARS-CoV-2/South Korea/SNU01/2020__EPI_ISL_411929 spike protein (1-1147)(A972C_R995C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFWALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGCISSVLNDILSRLDKVEAEVQIDCLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11499 - protein, 1301 aa, synthetic construct
  REGION 1..1301: note = SARS-CoV-2/China/WF0004/2020__EPI_ISL_413694 spike protein (1-1147)(A972C_R995C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWTESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGCISSVLNDILSRLDKVEAEVQIDCLITGRLQSLQTYVTQQLIRAAEIRASANLAATKMSECVLGQSKRFDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11500 - protein, 1301 aa, synthetic construct
  REGION 1..1301: note = SARS-CoV-2/China/WF0028/2020__EPI_ISL_413791 spike protein (1-1147)(A972C_R995C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGCISSVLNDILSRLDKVEAEVQIDCLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELESGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11501 - protein, 1301 aa, synthetic construct
  REGION 1..1301: note = SARS-CoV-2/2019-nCoV/USA-CruiseA-18/2020__MT159716.1 spike protein (1-1147)(A972C_R995C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESELRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGCISSVLNDILSRLDKVEAEVQIDCLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11502 - protein, 1301 aa, synthetic construct
  REGION 1..1301: note SARS-CoV-2/SARS-CoV-2/Yunnan-01/human/2020/CHN__MT049951.1 spike protein (1-1147)(A972C_R995C) WhcAg construct
MFVFLVLLPLVSSQCVNLTTRTQLPPANTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGCISSVLNDILSRLDKVEAEVQIDCLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11503 - protein, 1301 aa, synthetic construct
  REGION 1..1301: note = SARS-CoV-2/USA/WA-UW292/2020__EPI_ISL_418077 spike protein (1-1147)(A972C_R995C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQASSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGCISSVLNDILSRLDKVEAEVQIDCLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11504 - protein, 1301 aa, synthetic construct
  REGION 1..1301: note = SARS-CoV-2/Iceland/192/2020__EPI_ISL_417819 spike protein (1-1147)(A972C_R995C) WhcAg construct
MFVFFVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGCISSVLNDILSRLDKVEAEVQIDCLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11505 - protein, 1301 aa, synthetic construct
  REGION 1..1301: note = SARS-CoV-2/Belgium/ULG-6939/2020__EPI_ISL_417020 spike protein (1-1147)(A972C_R995C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVVYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGCISSVLNDILSRLDKVEAEVQIDCLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11506 - protein, 1301 aa, synthetic construct
  REGION 1..1301: note = SARS-CoV-2/France/HF2496/2020__EPI_ISL_418231 spike protein (1-1147)(A972C_R995C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIVARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGCISSVLNDILSRLDKVEAEVQIDCLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11507 - protein, 1301 aa, synthetic construct
  REGION 1..1301: note = SARS-CoV-2/USA/WA-UW291/2020__EPI_ISL_418076 spike protein (1-1147)(A972C_R995C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQYSLSSTASALGKLQDVVNQNAQALNTLVKQLSSNFGCISSVLNDILSRLDKVEAEVQIDCLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11508 - protein, 1301 aa, synthetic construct; identical to SEQ ID NO: 11471
  REGION 1..1301: note = SARS-CoV-2/Portugal/PT0034/2020__EPI_ISL_418019 spike protein (1-1147)(A972C_R995C) WhcAg construct

SEQ ID NO: 11509 - protein, 1301 aa, synthetic construct; identical to SEQ ID NO: 11463
  REGION 1..1301: note = SARS-CoV-2/Iceland/202/2020__EPI_ISL_417750 spike protein (1-1147)(A972C_R995C) WhcAg construct

SEQ ID NO: 11510 - protein, 1301 aa, synthetic construct
  REGION 1..1301: note = SARS-CoV-2/USA/WA-UW261/2020__EPI_ISL_418046 spike protein (1-1147)(A972C_R995C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFTSVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGCISSVLNDILSRLDKVEAEVQIDCLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11511 - protein, 1301 aa, synthetic construct
  REGION 1..1301: note = SARS-CoV-2/Portugal/PT0035/2020__EPI_ISL_418020 spike protein (1-1147)(A972C_R995C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDISARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGCISSVLNDILSRLDKVEAEVQIDCLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11512 - protein, 1301 aa, synthetic construct
  REGION 1..1301: note = SARS-CoV-2/USA/NY-NYUMC7/2020__EPI_ISL_418192 spike protein (1-1147)(A972C_R995C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYHHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGCISSVLNDILSRLDKVEAEVQIDCLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11513 - protein, 1301 aa, synthetic construct
  REGION 1..1301: note = SARS-CoV-2/Iceland/189/2020__EPI_ISL_417709 spike protein (1-1147)(A972C_R995C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFTKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGCISSVLNDILSRLDKVEAEVQIDCLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11514 - protein, 1301 aa, synthetic construct
  REGION 1..1301: note = SARS-CoV-2/Australia/NSW56/2020__EPI_ISL_417408 spike protein (1-1147)(A972C_R995C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDSSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGCISSVLNDILSRLDKVEAEVQIDCLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11515 - protein, 1301 aa, synthetic construct
  REGION 1..1301: note = SARS-CoV-2/Iceland/280/2020__EPI_ISL_417608 spike protein (1-1147)(A972C_R995C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYHTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGCISSVLNDILSRLDKVEAEVQIDCLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11516 - protein, 1301 aa, synthetic construct; identical to SEQ ID NO: 11471
  REGION 1..1301: note = SARS-CoV-2/Iceland/247/2020__EPI_ISL_417575 spike protein (1-1147)(A972C_R995C) WhcAg construct

SEQ ID NO: 11517 - protein, 1301 aa, synthetic construct
  REGION 1..1301: note = SARS-CoV-2/Iceland/238/2020__EPI_ISL_417566 spike protein (1-1147)(A972C_R995C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADVGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGCISSVLNDILSRLDKVEAEVQIDCLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11518 - protein, 1301 aa, synthetic construct
  REGION 1..1301: note = SARS-CoV-2/Greece/16/2020__EPI_ISL_418265 spike protein (1-1147)(A972C_R995C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNVDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGCISSVLNDILSRLDKVEAEVQIDCLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11519 - protein, 1301 aa, synthetic construct
  REGION 1..1301: note = SARS-CoV-2/Iceland/319/2020__EPI_ISL_417648 spike protein (1-1147)(A972C_R995C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLIDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGCISSVLNDILSRLDKVEAEVQIDCLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11520 - protein, 1301 aa, synthetic construct
  REGION 1..1301: note = SARS-CoV-2/Congo/94/2020__EPI_ISL_417947 spike protein (1-1147)(A972C_R995C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDILFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGCISSVLNDILSRLDKVEAEVQIDCLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11521 - protein, 1301 aa, synthetic construct
  REGION 1..1301: note = SARS-CoV-2/Congo/158/2020__EPI_ISL_417950 spike protein (1-1147)(A972C_R995C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGCISSVLNDILSRLDKVEAEVQIDCLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFLSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11522 - protein, 1301 aa, synthetic construct
  REGION 1..1301: note = SARS-CoV-2/USA/UT-00034/2020__EPI_ISL_417977 spike protein (1-1147)(A972C_R995C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYYKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGCISSVLNDILSRLDKVEAEVQIDCLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11523 - protein, 1301 aa, synthetic construct
  REGION 1..1301: note = SARS-CoV-2/USA/UT-00033/2020__EPI_ISL_417976 spike protein (1-1147)(A972C_R995C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGLTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGCISSVLNDILSRLDKVEAEVQIDCLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11524 - protein, 1301 aa, synthetic construct
  REGION 1..1301: note = SARS-CoV-2/USA/WI-13/2020__EPI_ISL_417516 spike protein (1-1147)(A972C_R995C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVLPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGCISSVLNDILSRLDKVEAEVQIDCLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11525 - protein, 1300 aa, synthetic construct
  REGION 1..1300: note = SARS-CoV-2/India/1-27/2020__EPI_ISL_413522 spike protein (1-1146)(A971C_R994C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVIQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGCISSVLNDILSRLDKVEAEVQIDCLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11526 - protein, 1295 aa, synthetic construct
  REGION 1..1295: note = SARS-CoV-2/pangolin/Guangxi/P4L/2017__EPI_ISL_410538 spike protein (1-1141)(A966C_R989C) WhcAg construct
MFVFLFVLPLVSSQCVNLTTRTGIPPGYTNSSTRGVYYPDKVFRSSILHLTQDLFLPFFSNVTWFNTINYQGGFKKFDNPVLPFNDGVYFASTEKSNIIRGWIFGTTLDARTQSLLIVNNATNVVIKVCEFQFCTDPFLGVYYHNNNKTWVENEFRVYSSANNCTFEYISQPFLMDLEGKQGNFKNLREFVFKNVDGYFKIYSKHTPIDLVRDLPRGFAALEPLVDLPIGINITRFQTLLALHRSYLTPGNLESGWTTGAAAYYVGYLQQRTFLLSYNQNGTITDAVDCSLDPLSETKCTLKSLTVEKGIYQTSNFRVQPTISIVRFPNITNLCPFGEVFNASKFASVYAWNRKRISNCVADYSVLYNSTSFSTFKCYGVSPTKLNDLCFTNVYADSFVVKGDEVRQIAPGQTGVIADYNYKLPDDFTGCVIAWNSVKQDALTGGNYGYLYRLFRKSKLKPFERDISTEIYQAGSTPCNGQVGLNCYYPLERYGFHPTTGVNYQPFRVVVLSFELLNGPATVCGPKLSTTLVKDKCVNFNFNGLTGTGVLTTSKKQFLPFQQFGRDISDTTDAVRDPQTLEILDITPCSFGGVSVITPGTNTSNQVAVLYQDVNCTEVPMAIHAEQLTPAWRVYSAGANVFQTRAGCLVGAEHVNNSYECDIPVGAGICASYHSMSSLRSVNQRSIIAYTMSLGAENSVAYSNNSIAIPTNFTISVTTEILPVSMTKTSVDCTMYICGDSIECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGCISSVLNDILSRLDKVEAEVQIDCLITGRLQSLQTYVTQQLIRAAEIRASANLAATKMSECVLGQSKRVDFCGKGYHLMSFPQSAPHGVVFLHVTYVPAQEKNFTTAPAICHEGKAHFPREGVFVSNGTHWFITQRNFYEPQIITTDNTFVSGSCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11527 - protein, 1295 aa, synthetic construct
  REGION 1..1295: note = SARS-CoV-2/pangolin/Guangxi/P5L/2017__EPI_ISL_410540 spike protein (1-1141)(A966C_R989C) WhcAg construct
MFVFLFVLPLVSSQCVNLTTRTGIPPGYTNSSTRGVYYPDKVFRSSILHLTQDLFLPFFSNVTWFNTINYQGGFKKFDNPVLPFNDGVYFASTEKSNIIRGWIFGTTLDARTQSLLIVNNATNVVIKVCEFQFCTDPFLGVYYHNNNKTWVENEFRVYSSANNCTFEYISQPFLMDLEGKQGNFKNLREFVFKNVDGYFKIYSKHTPIDLVRDLPRGFAALEPLVDLPIGINITRFQTLLALHRSYLTPGKLESGWTTGAAAYYVGYLQQRTFLLSYNQNGTITDAVDCSLDPLSETKCTLKSLTVEKGIYQTSNFRVQPTISIVRFPNITNLCPFGEVFNASKFASVYAWNRKRISNCVADYSVLYNSTSFSTFKCYGVSPTKLNDLCFTNVYADSFVVKGDEVRQIAPGQTGVIADYNYKLPDDFTGCVIAWNSVKQDALTGGNYGYLYRLFRKSKLKPFERDISTEIYQAGSTPCNGQVGLNCYYPLERYGFHPTTGVNYQPFRVVVLSFELLNGPATVCGPKLSTTLVKDKCVNFNFNGLTGTGVLTTSKKQFLPFQQFGRDISDTTDAVRDPQTLEILDITPCSFGGVSVITPGTNTSNQVAVLYQDVNCTEVPMAIHAEQLTPAWRVYSAGANVFQTRAGCLVGAEHVNNSYECDIPVGAGICASYHSMSSFRSVNQRSIIAYTMSLGAENSVAYSNNSIAIPTNFTISVTTEILPVSMTKTSVDCTMYICGDSIECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGCISSVLNDILSRLDKVEAEVQIDCLITGRLQSLQTYVTQQLIRAAEIRASANLAATKMSECVLGQSKRVDFCGKGYHLMSFPQSAPHGVVFLHVTYVPAQEKNFTTAPAICHEGKAHFPREGVFVSNGTHWFITQRNFYEPQIITTDNTFVSGSCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11528 - protein, 1295 aa, synthetic construct
  REGION 1..1295: note = SARS-CoV-2/pangolin/Guangxi/P5E/2017__EPI_ISL_410541 spike protein (1-1141)(A966C_R989C) WhcAg construct
MFVFLFVLPLVSSQCVNLTTRTGIPPGYTNSSTRGVYYPDKVFRSSILHLTQDLFLPFFSNVTWFNTITYQGGSKKFDNPVLPFNDGVYFASTEKSNIIRGWIFGTTLDARTQSLLIVNNATNVVIKVCEFQFCTDPFLGVYYHNNNKTWVENEFRVYSSANNCTFEYISQPFLMDLEGKQGNFKNLREFVFKNVDGYFKIYSKHTPIDLVRDLPRGFAALEPLVDLPIGINITRFQTLLALHRSYLTPGKLESGWTTGAAAYYVGYLQQRTFLLSYNQNGTITDAVDCSLDPLSETKCTLKSLTVEKGIYQTSNFRVQPTISIVRFPNITNLCPFGEVFNASKFASVYAWNRKRISNCVADYSVLYNSTSFSTFKCYGVSPTKLNDLCFTNVYADSFVVKGDEVRQIAPGQTGVIADYNYKLPDDFTGCVIAWNSVKQDALTGDNYGYLYRLFRKSKLKPFERDISTEIYQAGSTPCNGQVGLNCYYPLERYGFHPTTGVNYQPFRVVVLSFELLNGPATVCGPKLSTTLVKDKCVNFNFNGLTGTGVLTTSKKQFLPFQQFGRDISDTTDAVRDPQTLEILDITPCSFGGVSVITPGTNTSNQVAVLYQDVNCTEVPMAIHAEQLTPAWRVYSAGANVFQTRAGCLVGAEHVNNSYECDIPVGAGICASYHSMSSFRSVNQRSIIAYTMSLGAENSVAYSNNSIAIPTNFTISVTTEILPVSMTKTSVDCTMYICGDSIECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGCISSVLNDILSRLDKVEAEVQIDCLITGRLQSLQTYVTQQLIRAAEIRASANLAATKMSECVLGQSKRVDFCGKGYHLMSFPQSAPHGVVFLHVTYVPAQEKNFTTAPAICHEGKAHFPREGVFVSNGTHWFITQRNFYEPQIITTDNTFVSGSCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11529 - protein, 1293 aa, synthetic construct
  REGION 1..1293: note = SARS-CoV-2/pangolin/Guangxi/P1E/2017__EPI_ISL_410539 spike protein (1-1139)(A964C_R987C) WhcAg construct
MFVFLFVLPLVSSQCVNLTTRTGIQPGYTNSSTRGVYYPDKVFRSSILHLTQDLFLPFFSNVTWFNTINYQGGFKKFDNPVLPFNDGVYFASTEKSNIIRGWIFGTTLDARTQSLLIVNNATNVVIKVCEFQFCTDPFLGVYYHNNNKTWVENEFRVYSSANNCTFEYISQPFLMDLEGKQGNFKNLREFVFKNVDGYFKIYSKHTPIDLVRDLPRGFAALEPLVDLPIGINITRFQTLLALHRSYLTPGKLESGWTTGAAAYYVGYLQQRTFLLSYNQNGTITDAVDCSLDPLSETKCTLKSLTVEKGIYQTSNFRVQPTISIVRFPNITNLCPFGEVFNASKFASVYAWNRKRISNCVADYSVLYNSTSFSTFKCYGVSPTKLNDLCFTNVYADSFVVKGDEVRQIAPGQTGVIADYNYKLPDDFTGCVIAWNSVKQDALTGGNYLYRLFRKSKLKPFERDISTEIYQAGSTPCNGQVGLNCYYPLERYGFHPTTGVNYQPFRVVVLSFELLNGPATVCGPKLSTTLVKDKCVNFNFNGLTGTGVLTTSKKQFLPFQQFGRDISDTTDAVRDPQTLEILDITPCSFGGVSVITPGTNTSNQVAVLYQDVNCTEVPMAIHAEQLTPAWRVYSAGANVFQTRAGCLVGAEHVNNSYECDIPVGAGICASYHSMSSLRSVNQRSIIAYTMSLGAENSVAYSNNSIAIPTNFTISVTTEILPVSMTKTSVDCTMYICGDSIECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGCISSVLNDILSRLDKVEAEVQIDCLITGRLQSLQTYVTQQLIRAAEIRASANLAATKMSECVLGQSKRVDFCGKGYHLMSFPQSAPHGVVFLHVTYVPAQEKNFTTAPAICHEGKAHFPREGVFVSNGTHWFITQRNFYEPQIITTDNTFVSGSCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11530 - protein, 1301 aa, synthetic construct
  REGION 1..1301: note = SARS-CoV-2/Wuhan/WIV05/2019__EPI_ISL_402128 spike protein (1-1147)(A890C_V1040C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGCGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRCDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11531 - protein, 1297 aa, synthetic construct; identical to SEQ ID NO: 11263
  REGION 1..1297: note = SARS-CoV-2/bat/Yunnan/RaTG13/2013__EPI_ISL_402131 spike protein (1-1143)(A886C_V1036C) WhcAg construct

SEQ ID NO: 11532 - protein, 1301 aa, synthetic construct; identical to SEQ ID NO: 11264
  REGION 1..1301: note = SARS-CoV-2/Wuhan/HBCDC-HB-01/2019__EPI_ISL_402132 spike protein (1-1147)(A890C_V1040C) WhcAg construct

SEQ ID NO: 11533 - protein, 1301 aa, synthetic construct; identical to SEQ ID NO: 11265
  REGION 1..1301: note = SARS-CoV-2/Guangdong/20SF028/2020__EPI_ISL_403936 spike protein (1-1147)(A890C_V1040C) WhcAg construct

SEQ ID NO: 11534 - protein, 1301 aa, synthetic construct; identical to SEQ ID NO: 11266
  REGION 1..1301: note = SARS-CoV-2/Shenzhen/SZTH-001/2020__EPI_ISL_406592 spike protein (1-1147)(A890C_V1040C) WhcAg construct

SEQ ID NO: 11535 - protein, 1301 aa, synthetic construct; identical to SEQ ID NO: 11267
  REGION 1..1301: note = SARS-CoV-2/Shenzhen/SZTH-004/2020__EPI_ISL_406595 spike protein (1-1147)(A890C_V1040C) WhcAg construct

SEQ ID NO: 11536 - protein, 1301 aa, synthetic construct; identical to SEQ ID NO: 11268
  REGION 1..1301: note = SARS-CoV-2/France/IDF0372/2020__EPI_ISL_406596 spike protein (1-1147)(A890C_V1040C) WhcAg construct

SEQ ID NO: 11537 - protein, 1301 aa, synthetic construct; identical to SEQ ID NO: 11269
  REGION 1..1301: note = SARS-CoV-2/Australia/VIC01/2020__EPI_ISL_406844 spike protein (1-1147)(A890C_V1040C) WhcAg construct

SEQ ID NO: 11538 - protein, 1301 aa, synthetic construct; identical to SEQ ID NO: 11270
  REGION 1..1301: note = SARS-CoV-2/Germany/BavPat1/2020__EPI_ISL_406862 spike protein (1-1147)(A890C_V1040C) WhcAg construct

SEQ ID NO: 11539 - protein, 1301 aa, synthetic construct; identical to SEQ ID NO: 11271
  REGION 1..1301: note = SARS-CoV-2/Wuhan/HBCDC-HB-02/2020__EPI_ISL_412978 spike protein (1-1147)(A890C_V1040C) WhcAg construct

SEQ ID NO: 11540 - protein, 1301 aa, synthetic construct; identical to SEQ ID NO: 11272
  REGION 1..1301: note = SARS-CoV-2/Australia/QLD02/2020__EPI_ISL_407896 spike protein (1-1147)(A890C_V1040C) WhcAg construct

SEQ ID NO: 11541 - protein, 1301 aa, synthetic construct; identical to SEQ ID NO: 11273
  REGION 1..1301: note = SARS-CoV-2/India/1-31/2020__EPI_ISL_413523 spike protein (1-1147)(A890C_V1040C) WhcAg construct

SEQ ID NO: 11542 - protein, 1301 aa, synthetic construct; identical to SEQ ID NO: 11274
  REGION 1..1301: note SARS-CoV-2/Guangdong/GD2020087-P0008/2020__EPI_ISL_413863 spike protein (1-1147)(A890C_V1040C) WhcAg construct

SEQ ID NO: 11543 - protein, 1301 aa, synthetic construct; identical to SEQ ID NO: 11275
  REGION 1..1301: note = SARS-CoV-2/Sweden/01/2020__EPI_ISL_411951 spike protein (1-1147)(A890C_V1040C) WhcAg construct

SEQ ID NO: 11544 - protein, 1301 aa, synthetic construct; identical to SEQ ID NO: 11276
  REGION 1..1301: note = SARS-CoV-2/Tianmen/HBCDC-HB-07/2020__EPI_ISL_412983 spike protein (1-1147)(A890C_V1040C) WhcAg construct

SEQ ID NO: 11545 - protein, 1301 aa, synthetic construct; identical to SEQ ID NO: 11277
  REGION 1..1301: note = SARS-CoV-2/Hong Kong/case42_VM20002493/2020__EPI_ISL_414527 spike protein (1-1147)(A890C_V1040C) WhcAg construct

SEQ ID NO: 11546 - protein, 1301 aa, synthetic construct; identical to SEQ ID NO: 11278
  REGION 1..1301: note = SARS-CoV-2/USA/CruiseA-23/2020__EPI_ISL_414482 spike protein (1-1147)(A890C_V1040C) WhcAg construct

SEQ ID NO: 11547 - protein, 1301 aa, synthetic construct; identical to SEQ ID NO: 11279
  REGION 1..1301: note = SARS-CoV-2/Hong Kong/case85_VM20002868/2020__EPI_ISL_414519 spike protein (1-1147)(A890C_V1040C) WhcAg construct

SEQ ID NO: 11548 - protein, 1301 aa, synthetic construct; identical to SEQ ID NO: 11270
  REGION 1..1301: note = SARS-CoV-2/England/200990660/2020__EPI_ISL_414523 spike protein (1-1147)(A890C_V1040C) WhcAg construct

SEQ ID NO: 11549 - protein, 1301 aa, synthetic construct; identical to SEQ ID NO: 11281
  REGION 1..1301: note = SARS-CoV-2/Australia/NSW09/2020__EPI_ISL_413595 spike protein (1-1147)(A890C_V1040C) WhcAg construct

SEQ ID NO: 11550 - protein, 1301 aa, synthetic construct; identical to SEQ ID NO: 11262
  REGION 1..1301: note = SARS-CoV-2/Australia/NSW10/2020__EPI_ISL_413596 spike protein (1-1147)(A890C_V1040C) WhcAg construct

SEQ ID NO: 11551 - protein, 1301 aa, synthetic construct; identical to SEQ ID NO: 11283
  REGION 1..1301: note SARS-CoV-2/Switzerland/1000477797/2020__EPI_ISL_413023 spike protein (1-1147)(A890C_V1040C) WhcAg construct

SEQ ID NO: 11552 - protein, 1301 aa, synthetic construct; identical to SEQ ID NO: 11284
  REGION 1..1301: note = SARS-CoV-2/Belgium/BA-02291/2020__EPI_ISL_415159 spike protein (1-1147)(A890C_V1040C) WhcAg construct

SEQ ID NO: 11553 - protein, 1301 aa, synthetic construct; identical to SEQ ID NO: 11285
  REGION 1..1301: note = SARS-CoV-2/USA/WA8-UW5/2020__EPI_ISL_413486 spike protein (1-1147)(A890C_V1040C) WhcAg construct

SEQ ID NO: 11554 - protein, 1301 aa, synthetic construct; identical to SEQ ID NO: 11286
  REGION 1..1301: note = SARS-CoV-2/England/20102000506/2020__EPI_ISL_415147 spike protein (1-1147)(A890C_V1040C) WhcAg construct

SEQ ID NO: 11555 - protein, 1301 aa, synthetic construct; identical to SEQ ID NO: 11287
  REGION 1..1301: note = SARS-CoV-2/Belgium/VAG-03013/2020__EPI_ISL_415155 spike protein (1-1147)(A890C_V1040C) WhcAg construct

SEQ ID NO: 11556 - protein, 1301 aa, synthetic construct; identical to SEQ ID NO: 11288
  REGION 1..1301: note = SARS-CoV-2/Belgium/BC-03016/2020__EPI_ISL_415157 spike protein (1-1147)(A890C_V1040C) WhcAg construct

SEQ ID NO: 11557 - protein, 1301 aa, synthetic construct; identical to SEQ ID NO: 11289
  REGION 1..1301: note = SARS-CoV-2/Germany/BavPat3/2020__EPI_ISL_414521 spike protein (1-1147)(A890C_V1040C) WhcAg construct

SEQ ID NO: 11558 - protein, 1301 aa, synthetic construct; identical to SEQ ID NO: 11290
  REGION 1..1301: note = SARS-CoV-2/France/HF1805/2020__EPI_ISL_414628 spike protein (1-1147)(A890C_V1040C) WhcAg construct

SEQ ID NO: 11559 - protein, 1301 aa, synthetic construct; identical to SEQ ID NO: 11291
  REGION 1..1301: note SARS-CoV-2/Netherlands/ZuidHolland_9/2020__EPI_ISL_414445 spike protein (1-1147)(A890C_V1040C) WhcAg construct

SEQ ID NO: 11560 - protein, 1301 aa, synthetic construct; identical to SEQ ID NO: 11292
  REGION 1..1301: note = SARS-CoV-2/Finland/FIN03032020A/2020__EPI_ISL_413602 spike protein (1-1147)(A890C_V1040C) WhcAg construct

SEQ ID NO: 11561 - protein, 1301 aa, synthetic construct; identical to SEQ ID NO: 11293
  REGION 1..1301: note = SARS-CoV-2/France/GE1977/2020__EPI_ISL_414632 spike protein (1-1147)(A890C_V1040C) WhcAg construct

SEQ ID NO: 11562 - protein, 1301 aa, synthetic construct; identical to SEQ ID NO: 11294
  REGION 1..1301: note = SARS-CoV-2/Finland/FIN-313/2020__EPI_ISL_414641 spike protein (1-1147)(A890C_V1040C) WhcAg construct

SEQ ID NO: 11563 - protein, 1301 aa, synthetic construct; identical to SEQ ID NO: 11295
  REGION 1..1301: note SARS-CoV-2/Netherlands/ZuidHolland_2/2020__EPI_ISL_414556 spike protein (1-1147)(A890C_V1040C) WhcAg construct

SEQ ID NO: 11564 - protein, 1301 aa, synthetic construct; identical to SEQ ID NO: 11296
  REGION 1..1301: note = SARS-CoV-2/USA/WA-UW31/2020__EPI_ISL_414618 spike protein (1-1147)(A890C_V1040C) WhcAg construct

SEQ ID NO: 11565 - protein, 1301 aa, synthetic construct; identical to SEQ ID NO: 11297
  REGION 1..1301: note = SARS-CoV-2/South Korea/SNU01/2020__EPI_ISL_411929 spike protein (1-1147)(A890C_V1040C) WhcAg construct

SEQ ID NO: 11566 - protein, 1301 aa, synthetic construct; identical to SEQ ID NO: 11298
  REGION 1..1301: note = SARS-CoV-2/China/WF0004/2020__EPI_ISL_413694 spike protein (1-1147)(A890C_V1040C) WhcAg construct

SEQ ID NO: 11567 - protein, 1301 aa, synthetic construct; identical to SEQ ID NO: 11299
  REGION 1..1301: note = SARS-CoV-2/China/WF0028/2020__EPI_ISL_413791 spike protein (1-1147)(A890C_V1040C) WhcAg construct

SEQ ID NO: 11568 - protein, 1301 aa, synthetic construct; identical to SEQ ID NO: 11300
  REGION 1..1301: note = SARS-CoV-2/2019-nCoV/USA-CruiseA-18/2020__MT159716.1 spike protein (1-1147)(A890C_V1040C) WhcAg construct

SEQ ID NO: 11569 - protein, 1301 aa, synthetic construct; identical to SEQ ID NO: 11301
  REGION 1..1301: note SARS-CoV-2/SARS-CoV-2/Yunnan-01/human/2020/CHN__MT049951.1 spike protein (1-1147)(A890C_V1040C) WhcAg construct

SEQ ID NO: 11570 - protein, 1301 aa, synthetic construct; identical to SEQ ID NO: 11302
  REGION 1..1301: note = SARS-CoV-2/USA/WA-UW292/2020__EPI_ISL_418077 spike protein (1-1147)(A890C_V1040C) WhcAg construct

SEQ ID NO: 11571 - protein, 1301 aa, synthetic construct; identical to SEQ ID NO: 11303
  REGION 1..1301: note = SARS-CoV-2/Iceland/192/2020__EPI_ISL_417819 spike protein (1-1147)(A890C_V1040C) WhcAg construct

SEQ ID NO: 11572 - protein, 1301 aa, synthetic construct; identical to SEQ ID NO: 11304
  REGION 1..1301: note = SARS-CoV-2/Belgium/ULG-6939/2020__EPI_ISL_417020 spike protein (1-1147)(A890C_V1040C) WhcAg construct

SEQ ID NO: 11573 - protein, 1301 aa, synthetic construct; identical to SEQ ID NO: 11305
  REGION 1..1301: note = SARS-CoV-2/France/HF2496/2020__EPI_ISL_418231 spike protein (1-1147)(A890C_V1040C) WhcAg construct

SEQ ID NO: 11574 - protein, 1301 aa, synthetic construct; identical to SEQ ID NO: 11306
  REGION 1..1301: note = SARS-CoV-2/USA/WA-UW291/2020__EPI_ISL_418076 spike protein (1-1147)(A890C_V1040C) WhcAg construct

SEQ ID NO: 11575 - protein, 1301 aa, synthetic construct; identical to SEQ ID NO: 11270
  REGION 1..1301: note = SARS-CoV-2/Portugal/PT0034/2020__EPI_ISL_418019 spike protein (1-1147)(A890C_V1040C) WhcAg construct

SEQ ID NO: 11576 - protein, 1301 aa, synthetic construct; identical to SEQ ID NO: 11262
  REGION 1..1301: note = SARS-CoV-2/Iceland/202/2020__EPI_ISL_417750 spike protein (1-1147)(A890C_V1040C) WhcAg construct

SEQ ID NO: 11577 - protein, 1301 aa, synthetic construct; identical to SEQ ID NO: 11309
  REGION 1..1301: note = SARS-CoV-2/USA/WA-UW261/2020__EPI_ISL_418046 spike protein (1-1147)(A890C_V1040C) WhcAg construct

SEQ ID NO: 11578 - protein, 1301 aa, synthetic construct; identical to SEQ ID NO: 11310
  REGION 1..1301: note = SARS-CoV-2/Portugal/PT0035/2020__EPI_ISL_418020 spike protein (1-1147)(A890C_V1040C) WhcAg construct

SEQ ID NO: 11579 - protein, 1301 aa, synthetic construct; identical to SEQ ID NO: 11311
  REGION 1..1301: note = SARS-CoV-2/USA/NY-NYUMC7/2020__EPI_ISL_418192 spike protein (1-1147)(A890C_V1040C) WhcAg construct

SEQ ID NO: 11580 - protein, 1301 aa, synthetic construct; identical to SEQ ID NO: 11312
  REGION 1..1301: note = SARS-CoV-2/Iceland/189/2020__EPI_ISL_417709 spike protein (1-1147)(A890C_V1040C) WhcAg construct

SEQ ID NO: 11581 - protein, 1301 aa, synthetic construct; identical to SEQ ID NO: 11313
  REGION 1..1301: note = SARS-CoV-2/Australia/NSW56/2020__EPI_ISL_417408 spike protein (1-1147)(A890C_V1040C) WhcAg construct

SEQ ID NO: 11582 - protein, 1301 aa, synthetic construct; identical to SEQ ID NO: 11314
  REGION 1..1301: note = SARS-CoV-2/Iceland/280/2020__EPI_ISL_417608 spike protein (1-1147)(A890C_V1040C) WhcAg construct

SEQ ID NO: 11583 - protein, 1301 aa, synthetic construct; identical to SEQ ID NO: 11270
  REGION 1..1301: note = SARS-CoV-2/Iceland/247/2020__EPI_ISL_417575 spike protein (1-1147)(A890C_V1040C) WhcAg construct

SEQ ID NO: 11584 - protein, 1301 aa, synthetic construct; identical to SEQ ID NO: 11316
  REGION 1..1301: note = SARS-CoV-2/Iceland/238/2020__EPI_ISL_417566 spike protein (1-1147)(A890C_V1040C) WhcAg construct

SEQ ID NO: 11585 - protein, 1301 aa, synthetic construct; identical to SEQ ID NO: 11317
  REGION 1..1301: note = SARS-CoV-2/Greece/16/2020__EPI_ISL_418265 spike protein (1-1147)(A890C_V1040C) WhcAg construct

SEQ ID NO: 11586 - protein, 1301 aa, synthetic construct; identical to SEQ ID NO: 11318
  REGION 1..1301: note = SARS-CoV-2/Iceland/319/2020__EPI_ISL_417648 spike protein (1-1147)(A890C_V1040C) WhcAg construct

SEQ ID NO: 11587 - protein, 1301 aa, synthetic construct; identical to SEQ ID NO: 11319
  REGION 1..1301: note = SARS-CoV-2/Congo/94/2020__EPI_ISL_417947 spike protein (1-1147)(A890C_V1040C) WhcAg construct

SEQ ID NO: 11588 - protein, 1301 aa, synthetic construct; identical to SEQ ID NO: 11320
  REGION 1..1301: note = SARS-CoV-2/Congo/158/2020__EPI_ISL_417950 spike protein (1-1147)(A890C_V1040C) WhcAg construct

SEQ ID NO: 11589 - protein, 1301 aa, synthetic construct; identical to SEQ ID NO: 11321
  REGION 1..1301: note = SARS-CoV-2/USA/UT-00034/2020__EPI_ISL_417977 spike protein (1-1147)(A890C_V1040C) WhcAg construct

SEQ ID NO: 11590 - protein, 1301 aa, synthetic construct; identical to SEQ ID NO: 11322
  REGION 1..1301: note = SARS-CoV-2/USA/UT-00033/2020__EPI_ISL_417976 spike protein (1-1147)(A890C_V1040C) WhcAg construct

SEQ ID NO: 11591 - protein, 1301 aa, synthetic construct; identical to SEQ ID NO: 11323
  REGION 1..1301: note = SARS-CoV-2/USA/WI-13/2020__EPI_ISL_417516 spike protein (1-1147)(A890C_V1040C) WhcAg construct

SEQ ID NO: 11592 - protein, 1300 aa, synthetic construct; identical to SEQ ID NO: 11324
  REGION 1..1300: note = SARS-CoV-2/India/1-27/2020__EPI_ISL_413522 spike protein (1-1146)(A889C_V1039C) WhcAg construct

SEQ ID NO: 11593 - protein, 1295 aa, synthetic construct; identical to SEQ ID NO: 11325
  REGION 1..1295: note = SARS-CoV-2/pangolin/Guangxi/P4L/2017__EPI_ISL_410538 spike protein (1-1141)(A884C_V1034C) WhcAg construct

SEQ ID NO: 11594 - protein, 1295 aa, synthetic construct; identical to SEQ ID NO: 11326
  REGION 1..1295: note = SARS-CoV-2/pangolin/Guangxi/P5L/2017__EPI_ISL_410540 spike protein (1-1141)(A884C_V1034C) WhcAg construct

SEQ ID NO: 11595 - protein, 1295 aa, synthetic construct; identical to SEQ ID NO: 11327
  REGION 1..1295: note = SARS-CoV-2/pangolin/Guangxi/P5E/2017__EPI_ISL_410541 spike protein (1-1141)(A884C_V1034C) WhcAg construct

SEQ ID NO: 11596 - protein, 1293 aa, synthetic construct; identical to SEQ ID NO: 11328
  REGION 1..1293: note = SARS-CoV-2/pangolin/Guangxi/P1E/2017__EPI_ISL_410539 spike protein (1-1139)(A882C_V1032C) WhcAg construct

SEQ ID NO: 11597 - protein, 1301 aa, synthetic construct
  REGION 1..1301: note = SARS-CoV-2/Wuhan/WIV05/2019__EPI_ISL_402128 spike protein (1-1147)(T874C_S1055C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYCSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQCAPHGVVFLHVTYVPAQEKNFTTAPAICHDGKAHFPREGVFVSNGTHWFVTQRNFYEPQIITTDNTFVSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11598 - protein, 1297 aa, synthetic construct
  REGION 1..1297: note = SARS-CoV-2/bat/Yunnan/RaTG13/2013__EPI_ISL_402131 spike protein (1-1143)(T870C_S1051C) WhcAg construct
MFVFLVLLPLVSSQCVNLTTRTQLPPAYTNSSTRGVYYPDKVFRSSVLHLTQDLFLPFFSNVTWFHAIHVSGTNGIKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPPGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTDSIVRFPNITNLCPFGEVFNATTFASVYAWNRKRISNCVADYSVLYNSTSFSTFKCYGVSPTKLNDLCFTNVYADSFVITGDEVRQIAPGQTGKIADYNYKLPDDFTGCVIAWNSKHIDAKEGGNFNYLYRLFRKANLKPFERDISTEIYQAGSKPCNGQTGLNCYYPLYRYGFYPTDGVGHQPYRVVVLSFELLNAPATVCGPKKSTNLVKNKCVNFNFNGLTGTGVLTESNKKFLPFQQFGRDIADTTDAVRDPQTLEILDITPCSFGGVSVITPGTNASNQVAVLYQDVNCTEVPVAIHADQLTPTWRVYSTGSNVFQTRAGCLIGAEHVNNSYECDIPIGAGICASYQTQTNSRSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYCSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQCAPHGVVFLHVTYVPAQEKNFTTAPAICHDGKAHFPREGVFVSNGTHWFVTQRNFYEPQIITTDNTFVSGSCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11599 - protein, 1301 aa, synthetic construct
  REGION 1..1301: note = SARS-CoV-2/Wuhan/HBCDC-HB-01/2019__EPI_ISL_402132 spike protein (1-1147)(T874C_S1055C) WhcAg construct
MFVFLVLLPLVSSQCVNLTTRTQLPPAYTNSITRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYCSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQCAPHGVVFLHVTYVPAQEKNFTTAPAICHDGKAHFPREGVFVSNGTHWFVTQRNFYEPQIITTDNTFVSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11600 - protein, 1301 aa, synthetic construct
  REGION 1..1301: note = SARS-CoV-2/Guangdong/20SF028/2020__EPI_ISL_403936 spike protein (1-1147)(T874C_S1055C) WhcAg construct
MFVFLVLLPLVSSQCVNLTTRTQLPPAYTNSFTRGVYYPDKVFRSSVLYSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYCSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQCAPHGVVFLHVTYVPAQEKNFTTAPAICHDGKAHFPREGVFVSNGTHWFVTQRNFYEPQIITTDNTFVSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11601 - protein, 1301 aa, synthetic construct
  REGION 1..1301: note = SARS-CoV-2/Shenzhen/SZTH-001/2020__EPI_ISL_406592 spike protein (1-1147)(T874C_S1055C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYCSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQCAPHGVVFLHVTYVPAQEKNFTTAPAICHDGKAHFPREGVFVSNGTHWFVTQRNFYEPQIITTDNTFVSGNCDVLIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11602 - protein, 1301 aa, synthetic construct
  REGION 1..1301: note = SARS-CoV-2/Shenzhen/SZTH-004/2020__EPI_ISL_406595 spike protein (1-1147)(T874C_S1055C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWDRKRISNCVAYYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYCSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQCAPHGVVFLHVTYVPAQEKNFTTAPAICHDGKAHFPREGVFVSNGTHWFVTQRNFYEPQIITTDNTFVSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11603 - protein, 1301 aa, synthetic construct
  REGION 1..1301: note = SARS-CoV-2/France/IDF0372/2020__EPI_ISL_406596 spike protein (1-1147)(T874C_S1055C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSFLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYCSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQCAPHGVVFLHVTYVPAQEKNFTTAPAICHDGKAHFPREGVFVSNGTHWFVTQRNFYEPQIITTDNTFVSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11604 - protein, 1301 aa, synthetic construct
  REGION 1..1301: note = SARS-CoV-2/Australia/VIC01/2020__EPI_ISL_406844 spike protein (1-1147)(T874C_S1055C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRRYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYCSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQCAPHGVVFLHVTYVPAQEKNFTTAPAICHDGKAHFPREGVFVSNGTHWFVTQRNFYEPQIITTDNTFVSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11605 - protein, 1301 aa, synthetic construct
  REGION 1..1301: note = SARS-CoV-2/Germany/BavPat1/2020__EPI_ISL_406862 spike protein (1-1147)(T874C_S1055C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYCSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQCAPHGVVFLHVTYVPAQEKNFTTAPAICHDGKAHFPREGVFVSNGTHWFVTQRNFYEPQIITTDNTFVSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11606 - protein, 1301 aa, synthetic construct
  REGION 1..1301: note = SARS-CoV-2/Wuhan/HBCDC-HB-02/2020__EPI_ISL_412978 spike protein (1-1147)(T874C_S1055C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNFLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYCSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQCAPHGVVFLHVTYVPAQEKNFTTAPAICHDGKAHFPREGVFVSNGTHWFVTQRNFYEPQIITTDNTFVSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11607 - protein, 1301 aa, synthetic construct
  REGION 1..1301: note = SARS-CoV-2/Australia/QLD02/2020__EPI_ISL_407896 spike protein (1-1147)(T874C_S1055C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYCSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQCAPHGVVFLHVTYVPAQEKNFTTAPAICHDGKAHFPREGVFVSNGTHWFVTQRNFYEPQIITTDNTFVSGNCDVVIGIVNNTVYDPLQLELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11608 - protein, 1301 aa, synthetic construct
  REGION 1..1301: note = SARS-CoV-2/India/1-31/2020__EPI_ISL_413523 spike protein (1-1147)(T874C_S1055C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYCSALLAGTITSGWTFGAGAALQIPFAMQMAYRFNGIGVTQNVLYENQKLIANQFNSVIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQCAPHGVVFLHVTYVPAQEKNFTTAPAICHDGKAHFPREGVFVSNGTHWFVTQRNFYEPQIITTDNTFVSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11609 - protein, 1301 aa, synthetic construct
  REGION 1..1301: note SARS-CoV-2/Guangdong/GD2020087-P0008/2020__EPI_ISL_413863 spike protein (1-1147)(T874C_S1055C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVREIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYCSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQCAPHGVVFLHVTYVPAQEKNFTTAPAICHDGKAHFPREGVFVSNGTHWFVTQRNFYEPQIITTDNTFVSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11610 - protein, 1301 aa, synthetic construct
  REGION 1..1301: note = SARS-CoV-2/Sweden/01/2020__EPI_ISL_411951 spike protein (1-1147)(T874C_S1055C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDCGGFNFSQILPDPSKPSKRSFIEDLLFNKVTLADAGFIKQYGDCLGDIAARDLICAQKFNGLTVLPPLLTDEMIAQYCSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQCAPHGVVFLHVTYVPAQEKNFTTAPAICHDGKAHFPREGVFVSNGTHWFVTQRNFYEPQIITTDNTFVSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11611 - protein, 1301 aa, synthetic construct
  REGION 1..1301: note = SARS-CoV-2/Tianmen/HBCDC-HB-07/2020__EPI_ISL_412983 spike protein (1-1147)(T874C_S1055C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDLNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYCSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQCAPHGVVFLHVTYVPAQEKNFTTAPAICHDGKAHFPREGVFVSNGTHWFVTQRNFYEPQIITTDNTFVSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11612 - protein, 1301 aa, synthetic construct
  REGION 1..1301: note = SARS-CoV-2/Hong Kong/case42_VM20002493/2020__EPI_ISL_414527 spike protein (1-1147)(T874C_S1055C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFAISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYCSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQCAPHGVVFLHVTYVPAQEKNFTTAPAICHDGKAHFPREGVFVSNGTHWFVTQRNFYEPQIITTDNTFVSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11613 - protein, 1301 aa, synthetic construct
  REGION 1..1301: note = SARS-CoV-2/USA/CruiseA-23/2020__EPI_ISL_414482 spike protein (1-1147)(T874C_S1055C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEVKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYCSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQCAPHGVVFLHVTYVPAQEKNFTTAPAICHDGKAHFPREGVFVSNGTHWFVTQRNFYEPQIITTDNTFVSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11614 - protein, 1301 aa, synthetic construct
  REGION 1..1301: note = SARS-CoV-2/Hong Kong/case85_VM20002868/2020__EPI_ISL_414519 spike protein (1-1147)(T874C_S1055C) WhcAg construct
MFVFLVLVPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYCSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQCAPHGVVFLHVTYVPAQEKNFTTAPAICHDGKAHFPREGVFVSNGTHWFVTQRNFYEPQIITTDNTFVSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11615 - protein, 1301 aa, synthetic construct; identical to SEQ ID NO: 11605
  REGION 1..1301: note = SARS-CoV-2/England/200990660/2020__EPI_ISL_414523 spike protein (1-1147)(T874C_S1055C) WhcAg construct

SEQ ID NO: 11616 - protein, 1301 aa, synthetic construct
  REGION 1..1301: note = SARS-CoV-2/Australia/NSW09/2020__EPI_ISL_413595 spike protein (1-1147)(T874C_S1055C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYCSALLAGTITSGWTFGAGAALQIPFAMQMAYRFNGIGVTQNVLYENQKLIANQFNSAIGKIQDSLSFTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQCAPHGVVFLHVTYVPAQEKNFTTAPAICHDGKAHFPREGVFVSNGTHWFVTQRNFYEPQIITTDNTFVSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11617 - protein, 1301 aa, synthetic construct; identical to SEQ ID NO: 11597
  REGION 1..1301: note = SARS-CoV-2/Australia/NSW10/2020__EPI_ISL_413596 spike protein (1-1147)(T874C_S1055C) WhcAg construct

SEQ ID NO: 11618 - protein, 1301 aa, synthetic construct
  REGION 1..1301: note SARS-CoV-2/Switzerland/1000477797/2020__EPI_ISL_413023 spike protein (1-1147)(T874C_S1055C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFNIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYCSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQCAPHGVVFLHVTYVPAQEKNFTTAPAICHDGKAHFPREGVFVSNGTHWFVTQRNFYEPQIITTDNTFVSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11619 - protein, 1301 aa, synthetic construct
  REGION 1..1301: note = SARS-CoV-2/Belgium/BA-02291/2020__EPI_ISL_415159 spike protein (1-1147)(T874C_S1055C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRRSNLKPFERDISTEIYQAGSTPCNGVEGFNCYFPLQSYGFQPTNGVGYQPYRVVVLSFELLPAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYCSALLAGTITSGWTFGAGAALQIPFAMQMAYRFNGIGVTQNVLYENQKLIANQFNSAIGKIQDSLSSAAPALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQCAPHGVVFLHVTYVPAQEKNFTTAPAICHDGKAHFPREGVFVSNGTHWFVTQRNFYEPQIITTDNTFVSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11620 - protein, 1301 aa, synthetic construct
  REGION 1..1301: note = SARS-CoV-2/USA/WA8-UW5/2020__EPI_ISL_413486 spike protein (1-1147)(T874C_S1055C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEYVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYCSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQCAPHGVVFLHVTYVPAQEKNFTTAPAICHDGKAHFPREGVFVSNGTHWFVTQRNFYEPQIITTDNTFVSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11621 - protein, 1301 aa, synthetic construct
  REGION 1..1301: note = SARS-CoV-2/England/20102000506/2020__EPI_ISL_415147 spike protein (1-1147)(T874C_S1055C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGYCLGDIAARDLICAQKFNGLTVLPPLLTDEMIAQYCSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQCAPHGVVFLHVTYVPAQEKNFTTAPAICHDGKAHFPREGVFVSNGTHWFVTQRNFYEPQIITTDNTFVSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11622 - protein, 1301 aa, synthetic construct
  REGION 1..1301: note = SARS-CoV-2/Belgium/VAG-03013/2020__EPI_ISL_415155 spike protein (1-1147)(T874C_S1055C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYCSALLAGTITSGWTFGAGAALQIPFAMQMAYRFNGIGVTQNVLYENQKLIANQFNSAIGKIQDSLSSTATALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQCAPHGVVFLHVTYVPAQEKNFTTAPAICHDGKAHFPREGVFVSNGTHWFVTQRNFYEPQIITTDNTFVSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11623 - protein, 1301 aa, synthetic construct
  REGION 1..1301: note = SARS-CoV-2/Belgium/BC-03016/2020__EPI_ISL_415157 spike protein (1-1147)(T874C_S1055C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYCSALLAGTITSGWTFGAGAALQIPFAMQMAYRFNGIGVTQNVLYENQKLIANQFNSAIGKIQDSLSSTAPALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQCAPHGVVFLHVTYVPAQEKNFTTAPAICHDGKAHFPREGVFVSNGTHWFVTQRNFYEPQIITTDNTFVSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11624 - protein, 1301 aa, synthetic construct
  REGION 1..1301: note = SARS-CoV-2/Germany/BavPat3/2020__EPI_ISL_414521 spike protein (1-1147)(T874C_S1055C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQQVFAQVKQIYKTPPIKDFGGFNFSQILPDPSKPSKRSFIEDLLFNKVTLADAGFIKQYGDCLGDIAARDLICAQKFNGLTVLPPLLTDEMIAQYCSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQCAPHGVVFLHVTYVPAQEKNFTTAPAICHDGKAHFPREGVFVSNGTHWFVTQRNFYEPQIITTDNTFVSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11625 - protein, 1301 aa, synthetic construct
  REGION 1..1301: note = SARS-CoV-2/France/HF1805/2020__EPI_ISL_414628 spike protein (1-1147)(T874C_S1055C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYCSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQCAPHGVVFLHVTYVPAQEKNFTTAPAICHDGKAHFPREGVFVSNGTHWFVTQRNFYEPQIITTDNTFVSGNCDVVIGVVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11626 - protein, 1301 aa, synthetic construct
  REGION 1..1301: note SARS-CoV-2/Netherlands/ZuidHolland_9/2020__EPI_ISL_414445 spike protein (1-1147)(T874C_S1055C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICVQKFNGLTVLPPLLTDEMIAQYCSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQCAPHGVVFLHVTYVPAQEKNFTTAPAICHDGKAHFPREGVFVSNGTHWFVTQRNFYEPQIITTDNTFVSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11627 - protein, 1301 aa, synthetic construct
  REGION 1..1301: note = SARS-CoV-2/Finland/FIN03032020A/2020__EPI_ISL_413602 spike protein (1-1147)(T874C_S1055C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVISWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYCSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQCAPHGVVFLHVTYVPAQEKNFTTAPAICHDGKAHFPREGVFVSNGTHWFVTQRNFYEPQIITTDNTFVSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11628 - protein, 1301 aa, synthetic construct
  REGION 1..1301: note = SARS-CoV-2/France/GE1977/2020__EPI_ISL_414632 spike protein (1-1147)(T874C_S1055C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYCSALLAGTITSGWTFGAGAALQIPFAMQMAYRFNGIGVTQNVLYENQKLIANQFNSAIGKIQDSLFSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQCAPHGVVFLHVTYVPAQEKNFTTAPAICHDGKAHFPREGVFVSNGTHWFVTQRNFYEPQIITTDNTFVSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11629 - protein, 1301 aa, synthetic construct
  REGION 1..1301: note = SARS-CoV-2/Finland/FIN-313/2020__EPI_ISL_414641 spike protein (1-1147)(T874C_S1055C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFKTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYCSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQCAPHGVVFLHVTYVPAQEKNFTTAPAICHDGKAHFPREGVFVSNGTHWFVTQRNFYEPQIITTDNTFVSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11630 - protein, 1301 aa, synthetic construct
  REGION 1..1301: note SARS-CoV-2/Netherlands/ZuidHolland_2/2020__EPI_ISL_414556 spike protein (1-1147)(T874C_S1055C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIALEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYCSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQCAPHGVVFLHVTYVPAQEKNFTTAPAICHDGKAHFPREGVFVSNGTHWFVTQRNFYEPQIITTDNTFVSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11631 - protein, 1301 aa, synthetic construct
  REGION 1..1301: note = SARS-CoV-2/USA/WA-UW31/2020__EPI_ISL_414618 spike protein (1-1147)(T874C_S1055C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGAEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYCSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQCAPHGVVFLHVTYVPAQEKNFTTAPAICHDGKAHFPREGVFVSNGTHWFVTQRNFYEPQIITTDNTFVSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11632 - protein, 1301 aa, synthetic construct
  REGION 1..1301: note = SARS-CoV-2/South Korea/SNU01/2020__EPI_ISL_411929 spike protein (1-1147)(T874C_S1055C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFWALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYCSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQCAPHGVVFLHVTYVPAQEKNFTTAPAICHDGKAHFPREGVFVSNGTHWFVTQRNFYEPQIITTDNTFVSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11633 - protein, 1301 aa, synthetic construct
  REGION 1..1301: note = SARS-CoV-2/China/WF0004/2020__EPI_ISL_413694 spike protein (1-1147)(T874C_S1055C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWTESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYCSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRFDFCGKGYHLMSFPQCAPHGVVFLHVTYVPAQEKNFTTAPAICHDGKAHFPREGVFVSNGTHWFVTQRNFYEPQIITTDNTFVSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11634 - protein, 1301 aa, synthetic construct
  REGION 1..1301: note = SARS-CoV-2/China/WF0028/2020__EPI_ISL_413791 spike protein (1-1147)(T874C_S1055C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYCSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQCAPHGVVFLHVTYVPAQEKNFTTAPAICHDGKAHFPREGVFVSNGTHWFVTQRNFYEPQIITTDNTFVSGNCDVVIGIVNNTVYDPLQPELESGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11635 - protein, 1301 aa, synthetic construct
  REGION 1..1301: note = SARS-CoV-2/2019-nCoV/USA-CruiseA-18/2020__MT159716.1 spike protein (1-1147)(T874C_S1055C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESELRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYCSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQCAPHGVVFLHVTYVPAQEKNFTTAPAICHDGKAHFPREGVFVSNGTHWFVTQRNFYEPQIITTDNTFVSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11636 - protein, 1301 aa, synthetic construct
  REGION 1..1301: note SARS-CoV-2/SARS-CoV-2/Yunnan-01/human/2020/CHN__MT049951.1 spike protein (1-1147)(T874C_S1055C) WhcAg construct
MFVFLVLLPLVSSQCVNLTTRTQLPPANTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYCSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQCAPHGVVFLHVTYVPAQEKNFTTAPAICHDGKAHFPREGVFVSNGTHWFVTQRNFYEPQIITTDNTFVSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11637 - protein, 1301 aa, synthetic construct
  REGION 1..1301: note = SARS-CoV-2/USA/WA-UW292/2020__EPI_ISL_418077 spike protein (1-1147)(T874C_S1055C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQASSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYCSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQCAPHGVVFLHVTYVPAQEKNFTTAPAICHDGKAHFPREGVFVSNGTHWFVTQRNFYEPQIITTDNTFVSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11638 - protein, 1301 aa, synthetic construct
  REGION 1..1301: note = SARS-CoV-2/Iceland/192/2020__EPI_ISL_417819 spike protein (1-1147)(T874C_S1055C) WhcAg construct
MFVFFVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYCSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQCAPHGVVFLHVTYVPAQEKNFTTAPAICHDGKAHFPREGVFVSNGTHWFVTQRNFYEPQIITTDNTFVSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11639 - protein, 1301 aa, synthetic construct
  REGION 1..1301: note = SARS-CoV-2/Belgium/ULG-6939/2020__EPI_ISL_417020 spike protein (1-1147)(T874C_S1055C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVVYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYCSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQCAPHGVVFLHVTYVPAQEKNFTTAPAICHDGKAHFPREGVFVSNGTHWFVTQRNFYEPQIITTDNTFVSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11640 - protein, 1301 aa, synthetic construct
  REGION 1..1301: note = SARS-CoV-2/France/HF2496/2020__EPI_ISL_418231 spike protein (1-1147)(T874C_S1055C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIVARDLICAQKFNGLTVLPPLLTDEMIAQYCSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQCAPHGVVFLHVTYVPAQEKNFTTAPAICHDGKAHFPREGVFVSNGTHWFVTQRNFYEPQIITTDNTFVSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11641 - protein, 1301 aa, synthetic construct
  REGION 1..1301: note = SARS-CoV-2/USA/WA-UW291/2020__EPI_ISL_418076 spike protein (1-1147)(T874C_S1055C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYCSALLAGTITSGWTFGAGAALQIPFAMQMAYRFNGIGVTQNVLYENQKLIANQFNSAIGKIQYSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQCAPHGVVFLHVTYVPAQEKNFTTAPAICHDGKAHFPREGVFVSNGTHWFVTQRNFYEPQIITTDNTFVSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11642 - protein, 1301 aa, synthetic construct; identical to SEQ ID NO: 11605
  REGION 1..1301: note = SARS-CoV-2/Portugal/PT0034/2020__EPI_ISL_418019 spike protein (1-1147)(T874C_S1055C) WhcAg construct

SEQ ID NO: 11643 - protein, 1301 aa, synthetic construct; identical to SEQ ID NO: 11597
  REGION 1..1301: note = SARS-CoV-2/Iceland/202/2020__EPI_ISL_417750 spike protein (1-1147)(T874C_S1055C) WhcAg construct

SEQ ID NO: 11644 - protein, 1301 aa, synthetic construct
  REGION 1..1301: note = SARS-CoV-2/USA/WA-UW261/2020__EPI_ISL_418046 spike protein (1-1147)(T874C_S1055C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFTSVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYCSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQCAPHGVVFLHVTYVPAQEKNFTTAPAICHDGKAHFPREGVFVSNGTHWFVTQRNFYEPQIITTDNTFVSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11645 - protein, 1301 aa, synthetic construct
  REGION 1..1301: note = SARS-CoV-2/Portugal/PT0035/2020__EPI_ISL_418020 spike protein (1-1147)(T874C_S1055C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDISARDLICAQKFNGLTVLPPLLTDEMIAQYCSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQCAPHGVVFLHVTYVPAQEKNFTTAPAICHDGKAHFPREGVFVSNGTHWFVTQRNFYEPQIITTDNTFVSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11646 - protein, 1301 aa, synthetic construct
  REGION 1..1301: note = SARS-CoV-2/USA/NY-NYUMC7/2020__EPI_ISL_418192 spike protein (1-1147)(T874C_S1055C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYHHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYCSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQCAPHGVVFLHVTYVPAQEKNFTTAPAICHDGKAHFPREGVFVSNGTHWFVTQRNFYEPQIITTDNTFVSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11647 - protein, 1301 aa, synthetic construct
  REGION 1..1301: note = SARS-CoV-2/Iceland/189/2020__EPI_ISL_417709 spike protein (1-1147)(T874C_S1055C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFTKQYGDCLGDIAARDLICAQKFNGLTVLPPLLTDEMIAQYCSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQCAPHGVVFLHVTYVPAQEKNFTTAPAICHDGKAHFPREGVFVSNGTHWFVTQRNFYEPQIITTDNTFVSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11648 - protein, 1301 aa, synthetic construct
  REGION 1..1301: note = SARS-CoV-2/Australia/NSW56/2020__EPI_ISL_417408 spike protein (1-1147)(T874C_S1055C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDSSKPSKRSFIEDLLFNKVTLADAGFIKQYGDCLGDIAARDLICAQKFNGLTVLPPLLTDEMIAQYCSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQCAPHGVVFLHVTYVPAQEKNFTTAPAICHDGKAHFPREGVFVSNGTHWFVTQRNFYEPQIITTDNTFVSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11649 - protein, 1301 aa, synthetic construct
  REGION 1..1301: note = SARS-CoV-2/Iceland/280/2020__EPI_ISL_417608 spike protein (1-1147)(T874C_S1055C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYHTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYCSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQCAPHGVVFLHVTYVPAQEKNFTTAPAICHDGKAHFPREGVFVSNGTHWFVTQRNFYEPQIITTDNTFVSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11650 - protein, 1301 aa, synthetic construct; identical to SEQ ID NO: 11605
  REGION 1..1301: note = SARS-CoV-2/Iceland/247/2020__EPI_ISL_417575 spike protein (1-1147)(T874C_S1055C) WhcAg construct

SEQ ID NO: 11651 - protein, 1301 aa, synthetic construct
  REGION 1..1301: note = SARS-CoV-2/Iceland/238/2020__EPI_ISL_417566 spike protein (1-1147)(T874C_S1055C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADVGFIKQYGDCLGDIAARDLICAQKFNGLTVLPPLLTDEMIAQYCSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQCAPHGVVFLHVTYVPAQEKNFTTAPAICHDGKAHFPREGVFVSNGTHWFVTQRNFYEPQIITTDNTFVSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11652 - protein, 1301 aa, synthetic construct
  REGION 1..1301: note = SARS-CoV-2/Greece/16/2020__EPI_ISL_418265 spike protein (1-1147)(T874C_S1055C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNVDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYCSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQCAPHGVVFLHVTYVPAQEKNFTTAPAICHDGKAHFPREGVFVSNGTHWFVTQRNFYEPQIITTDNTFVSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11653 - protein, 1301 aa, synthetic construct
  REGION 1..1301: note = SARS-CoV-2/Iceland/319/2020__EPI_ISL_417648 spike protein (1-1147)(T874C_S1055C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLIDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYCSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQCAPHGVVFLHVTYVPAQEKNFTTAPAICHDGKAHFPREGVFVSNGTHWFVTQRNFYEPQIITTDNTFVSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11654 - protein, 1301 aa, synthetic construct
  REGION 1..1301: note = SARS-CoV-2/Congo/94/2020__EPI_ISL_417947 spike protein (1-1147)(T874C_S1055C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDILFNKVTLADAGFIKQYGDCLGDIAARDLICAQKFNGLTVLPPLLTDEMIAQYCSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQCAPHGVVFLHVTYVPAQEKNFTTAPAICHDGKAHFPREGVFVSNGTHWFVTQRNFYEPQIITTDNTFVSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11655 - protein, 1301 aa, synthetic construct
  REGION 1..1301: note = SARS-CoV-2/Congo/158/2020__EPI_ISL_417950 spike protein (1-1147)(T874C_S1055C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYCSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQCAPHGVVFLHVTYVPAQEKNFTTAPAICHDGKAHFPREGVFVSNGTHWFVTQRNFYEPQIITTDNTFLSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11656 - protein, 1301 aa, synthetic construct
  REGION 1..1301: note = SARS-CoV-2/USA/UT-00034/2020__EPI_ISL_417977 spike protein (1-1147)(T874C_S1055C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYYKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYCSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQCAPHGVVFLHVTYVPAQEKNFTTAPAICHDGKAHFPREGVFVSNGTHWFVTQRNFYEPQIITTDNTFVSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11657 - protein, 1301 aa, synthetic construct
  REGION 1..1301: note = SARS-CoV-2/USA/UT-00033/2020__EPI_ISL_417976 spike protein (1-1147)(T874C_S1055C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGLTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYCSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQCAPHGVVFLHVTYVPAQEKNFTTAPAICHDGKAHFPREGVFVSNGTHWFVTQRNFYEPQIITTDNTFVSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11658 - protein, 1301 aa, synthetic construct
  REGION 1..1301: note = SARS-CoV-2/USA/WI-13/2020__EPI_ISL_417516 spike protein (1-1147)(T874C_S1055C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVLPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYCSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQCAPHGVVFLHVTYVPAQEKNFTTAPAICHDGKAHFPREGVFVSNGTHWFVTQRNFYEPQIITTDNTFVSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11659 - protein, 1300 aa, synthetic construct
  REGION 1..1300: note = SARS-CoV-2/India/1-27/2020__EPI_ISL_413522 spike protein (1-1146)(T873C_S1054C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVIQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYCSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQCAPHGVVFLHVTYVPAQEKNFTTAPAICHDGKAHFPREGVFVSNGTHWFVTQRNFYEPQIITTDNTFVSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11660 - protein, 1295 aa, synthetic construct
  REGION 1..1295: note = SARS-CoV-2/pangolin/Guangxi/P4L/2017__EPI_ISL_410538 spike protein (1-1141)(T868C_S1049C) WhcAg construct
MFVFLFVLPLVSSQCVNLTTRTGIPPGYTNSSTRGVYYPDKVFRSSILHLTQDLFLPFFSNVTWFNTINYQGGFKKFDNPVLPFNDGVYFASTEKSNIIRGWIFGTTLDARTQSLLIVNNATNVVIKVCEFQFCTDPFLGVYYHNNNKTWVENEFRVYSSANNCTFEYISQPFLMDLEGKQGNFKNLREFVFKNVDGYFKIYSKHTPIDLVRDLPRGFAALEPLVDLPIGINITRFQTLLALHRSYLTPGNLESGWTTGAAAYYVGYLQQRTFLLSYNQNGTITDAVDCSLDPLSETKCTLKSLTVEKGIYQTSNFRVQPTISIVRFPNITNLCPFGEVFNASKFASVYAWNRKRISNCVADYSVLYNSTSFSTFKCYGVSPTKLNDLCFTNVYADSFVVKGDEVRQIAPGQTGVIADYNYKLPDDFTGCVIAWNSVKQDALTGGNYGYLYRLFRKSKLKPFERDISTEIYQAGSTPCNGQVGLNCYYPLERYGFHPTTGVNYQPFRVVVLSFELLNGPATVCGPKLSTTLVKDKCVNFNFNGLTGTGVLTTSKKQFLPFQQFGRDISDTTDAVRDPQTLEILDITPCSFGGVSVITPGTNTSNQVAVLYQDVNCTEVPMAIHAEQLTPAWRVYSAGANVFQTRAGCLVGAEHVNNSYECDIPVGAGICASYHSMSSLRSVNQRSIIAYTMSLGAENSVAYSNNSIAIPTNFTISVTTEILPVSMTKTSVDCTMYICGDSIECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYCSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQCAPHGVVFLHVTYVPAQEKNFTTAPAICHEGKAHFPREGVFVSNGTHWFITQRNFYEPQIITTDNTFVSGSCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11661 - protein, 1295 aa, synthetic construct
  REGION 1..1295: note = SARS-CoV-2/pangolin/Guangxi/P5L/2017__EPI_ISL_410540 spike protein (1-1141)(T868C_S1049C) WhcAg construct
MFVFLFVLPLVSSQCVNLTTRTGIPPGYTNSSTRGVYYPDKVFRSSILHLTQDLFLPFFSNVTWFNTINYQGGFKKFDNPVLPFNDGVYFASTEKSNIIRGWIFGTTLDARTQSLLIVNNATNVVIKVCEFQFCTDPFLGVYYHNNNKTWVENEFRVYSSANNCTFEYISQPFLMDLEGKQGNFKNLREFVFKNVDGYFKIYSKHTPIDLVRDLPRGFAALEPLVDLPIGINITRFQTLLALHRSYLTPGKLESGWTTGAAAYYVGYLQQRTFLLSYNQNGTITDAVDCSLDPLSETKCTLKSLTVEKGIYQTSNFRVQPTISIVRFPNITNLCPFGEVFNASKFASVYAWNRKRISNCVADYSVLYNSTSFSTFKCYGVSPTKLNDLCFTNVYADSFVVKGDEVRQIAPGQTGVIADYNYKLPDDFTGCVIAWNSVKQDALTGGNYGYLYRLFRKSKLKPFERDISTEIYQAGSTPCNGQVGLNCYYPLERYGFHPTTGVNYQPFRVVVLSFELLNGPATVCGPKLSTTLVKDKCVNFNFNGLTGTGVLTTSKKQFLPFQQFGRDISDTTDAVRDPQTLEILDITPCSFGGVSVITPGTNTSNQVAVLYQDVNCTEVPMAIHAEQLTPAWRVYSAGANVFQTRAGCLVGAEHVNNSYECDIPVGAGICASYHSMSSFRSVNQRSIIAYTMSLGAENSVAYSNNSIAIPTNFTISVTTEILPVSMTKTSVDCTMYICGDSIECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYCSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQCAPHGVVFLHVTYVPAQEKNFTTAPAICHEGKAHFPREGVFVSNGTHWFITQRNFYEPQIITTDNTFVSGSCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11662 - protein, 1295 aa, synthetic construct
  REGION 1..1295: note = SARS-CoV-2/pangolin/Guangxi/P5E/2017__EPI_ISL_410541 spike protein (1-1141)(T868C_S1049C) WhcAg construct
MFVFLFVLPLVSSQCVNLTTRTGIPPGYTNSSTRGVYYPDKVFRSSILHLTQDLFLPFFSNVTWFNTITYQGGSKKFDNPVLPFNDGVYFASTEKSNIIRGWIFGTTLDARTQSLLIVNNATNVVIKVCEFQFCTDPFLGVYYHNNNKTWVENEFRVYSSANNCTFEYISQPFLMDLEGKQGNFKNLREFVFKNVDGYFKIYSKHTPIDLVRDLPRGFAALEPLVDLPIGINITRFQTLLALHRSYLTPGKLESGWTTGAAAYYVGYLQQRTFLLSYNQNGTITDAVDCSLDPLSETKCTLKSLTVEKGIYQTSNFRVQPTISIVRFPNITNLCPFGEVFNASKFASVYAWNRKRISNCVADYSVLYNSTSFSTFKCYGVSPTKLNDLCFTNVYADSFVVKGDEVRQIAPGQTGVIADYNYKLPDDFTGCVIAWNSVKQDALTGDNYGYLYRLFRKSKLKPFERDISTEIYQAGSTPCNGQVGLNCYYPLERYGFHPTTGVNYQPFRVVVLSFELLNGPATVCGPKLSTTLVKDKCVNFNFNGLTGTGVLTTSKKQFLPFQQFGRDISDTTDAVRDPQTLEILDITPCSFGGVSVITPGTNTSNQVAVLYQDVNCTEVPMAIHAEQLTPAWRVYSAGANVFQTRAGCLVGAEHVNNSYECDIPVGAGICASYHSMSSFRSVNQRSIIAYTMSLGAENSVAYSNNSIAIPTNFTISVTTEILPVSMTKTSVDCTMYICGDSIECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYCSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQCAPHGVVFLHVTYVPAQEKNFTTAPAICHEGKAHFPREGVFVSNGTHWFITQRNFYEPQIITTDNTFVSGSCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11663 - protein, 1293 aa, synthetic construct
  REGION 1..1293: note = SARS-CoV-2/pangolin/Guangxi/P1E/2017__EPI_ISL_410539 spike protein (1-1139)(T866C_S1047C) WhcAg construct
MFVFLFVLPLVSSQCVNLTTRTGIQPGYTNSSTRGVYYPDKVFRSSILHLTQDLFLPFFSNVTWFNTINYQGGFKKFDNPVLPFNDGVYFASTEKSNIIRGWIFGTTLDARTQSLLIVNNATNVVIKVCEFQFCTDPFLGVYYHNNNKTWVENEFRVYSSANNCTFEYISQPFLMDLEGKQGNFKNLREFVFKNVDGYFKIYSKHTPIDLVRDLPRGFAALEPLVDLPIGINITRFQTLLALHRSYLTPGKLESGWTTGAAAYYVGYLQQRTFLLSYNQNGTITDAVDCSLDPLSETKCTLKSLTVEKGIYQTSNFRVQPTISIVRFPNITNLCPFGEVFNASKFASVYAWNRKRISNCVADYSVLYNSTSFSTFKCYGVSPTKLNDLCFTNVYADSFVVKGDEVRQIAPGQTGVIADYNYKLPDDFTGCVIAWNSVKQDALTGGNYLYRLFRKSKLKPFERDISTEIYQAGSTPCNGQVGLNCYYPLERYGFHPTTGVNYQPFRVVVLSFELLNGPATVCGPKLSTTLVKDKCVNFNFNGLTGTGVLTTSKKQFLPFQQFGRDISDTTDAVRDPQTLEILDITPCSFGGVSVITPGTNTSNQVAVLYQDVNCTEVPMAIHAEQLTPAWRVYSAGANVFQTRAGCLVGAEHVNNSYECDIPVGAGICASYHSMSSLRSVNQRSIIAYTMSLGAENSVAYSNNSIAIPTNFTISVTTEILPVSMTKTSVDCTMYICGDSIECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYCSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQCAPHGVVFLHVTYVPAQEKNFTTAPAICHEGKAHFPREGVFVSNGTHWFITQRNFYEPQIITTDNTFVSGSCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11664 - RNA, 3822 nt, synthetic construct; identical to SEQ ID NO: 116
  misc_feature 1..3822: note = SARS-CoV-2/Wuhan/WIV05/2019__EPI_ISL_402128 spike protein CDS wt (1-1273)
  source 1..3822: mol_type = other RNA

SEQ ID NO: 11665 - RNA, 3810 nt, synthetic construct; identical to SEQ ID NO: 118
  misc_feature 1..3810: note = SARS-CoV-2/bat/Yunnan/RaTG13/2013__EPI_ISL_402131 spike protein CDS wt (1-1269)
  source 1..3810: mol_type = other RNA

SEQ ID NO: 11666 - RNA, 3822 nt, synthetic construct; identical to SEQ ID NO: 119
  misc_feature 1..3822: note = SARS-CoV-2/Wuhan/HBCDC-HB-01/2019__EPI_ISL_402132 spike protein CDS wt (1-1273)
  source 1..3822: mol_type = other RNA

SEQ ID NO: 11667 - RNA, 3822 nt, synthetic construct; identical to SEQ ID NO: 121
  misc_feature 1..3822: note = SARS-CoV-2/Guangdong/20SF028/2020__EPI_ISL_403936 spike protein CDS wt (1-1273)
  source 1..3822: mol_type = other RNA

SEQ ID NO: 11668 - RNA, 3822 nt, synthetic construct; identical to SEQ ID NO: 126
  misc_feature 1..3822: note = SARS-CoV-2/Shenzhen/SZTH-001/2020__EPI_ISL_406592 spike protein CDS wt (1-1273)
  source 1..3822: mol_type = other RNA

SEQ ID NO: 11669 - RNA, 3822 nt, synthetic construct; identical to SEQ ID NO: 127
  misc_feature 1..3822: note = SARS-CoV-2/Shenzhen/SZTH-004/2020__EPI_ISL_406595 spike protein CDS wt (1-1273)
  source 1..3822: mol_type = other RNA

SEQ ID NO: 11670 - RNA, 3822 nt, synthetic construct; identical to SEQ ID NO: 128
  misc_feature 1..3822: note = SARS-CoV-2/France/IDF0372/2020__EPI_ISL_406596 spike protein CDS wt (1-1273)
  source 1..3822: mol_type = other RNA

SEQ ID NO: 11671 - RNA, 3822 nt, synthetic construct; identical to SEQ ID NO: 130
  misc_feature 1..3822: note = SARS-CoV-2/Australia/VIC01/2020__EPI_ISL_406844 spike protein CDS wt (1-1273)
  source 1..3822: mol_type = other RNA

SEQ ID NO: 11672 - RNA, 3822 nt, synthetic construct; identical to SEQ ID NO: 131
  misc_feature 1..3822: note = SARS-CoV-2/Germany/BavPat1/2020__EPI_ISL_406862 spike protein CDS wt (1-1273)
  source 1..3822: mol_type = other RNA

SEQ ID NO: 11673 - RNA, 3822 nt, synthetic construct
  misc_feature 1..3822: note = SARS-CoV-2/Wuhan/HBCDC-HB-02/2020__EPI_ISL_412978 spike protein CDS wt (1-1273)
  source 1..3822: mol_type = other RNA
atgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcaggatgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaattttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataa

SEQ ID NO: 11674 - RNA, 3822 nt, synthetic construct
  misc_feature 1..3822: note = SARS-CoV-2/Australia/QLD02/2020__EPI_ISL_407896 spike protein CDS wt (1-1273)
  source 1..3822: mol_type = other RNA
atgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcaggatgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacttgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataa

SEQ ID NO: 11675 - RNA, 3822 nt, synthetic construct
  misc_feature 1..3822: note = SARS-CoV-2/India/1-31/2020__EPI_ISL_413523 spike protein CDS wt (1-1273)
  source 1..3822: mol_type = other RNA
atgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcaggatgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgttattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataa

SEQ ID NO: 11676 - RNA, 3822 nt, synthetic construct
  misc_feature 1..3822: note SARS-CoV-2/Guangdong/GD2020087-P0008/2020__EPI_ISL_413863 spike protein CDS wt (1-1273)
  source 1..3822: mol_type = other RNA
atgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagagaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcaggatgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataa

SEQ ID NO: 11677 - RNA, 3822 nt, synthetic construct
  misc_feature 1..3822: note = SARS-CoV-2/Sweden/01/2020__EPI_ISL_411951 spike protein CDS wt (1-1273)
  source 1..3822: mol_type = other RNA
atgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcaggatgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattgtggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataa

SEQ ID NO: 11678 - RNA, 3822 nt, synthetic construct
  misc_feature 1..3822: note = SARS-CoV-2/Tianmen/HBCDC-HB-07/2020__EPI_ISL_412983 spike protein CDS wt (1-1273)
  source 1..3822: mol_type = other RNA
atgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcaggatcttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataa

SEQ ID NO: 11679 - RNA, 3822 nt, synthetic construct
  misc_feature 1..3822: note = SARS-CoV-2/Hong Kong/case42_VM20002493/2020__EPI_ISL_414527 spike protein CDS wt (1-1273)
  source 1..3822: mol_type = other RNA
atgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcaggatgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttgctattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataa

SEQ ID NO: 11680 - RNA, 3822 nt, synthetic construct
  misc_feature 1..3822: note = SARS-CoV-2/USA/CruiseA-23/2020__EPI_ISL_414482 spike protein CDS wt (1-1273)
  source 1..3822: mol_type = other RNA
atgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaagtaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcaggatgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataa

SEQ ID NO: 11681 - RNA, 3822 nt, synthetic construct
  misc_feature 1..3822: note = SARS-CoV-2/Hong Kong/case85_VM20002868/2020__EPI_ISL_414519 spike protein CDS wt (1-1273)
  source 1..3822: mol_type = other RNA
atgtttgtttttcttgttttagtgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcaggatgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataa

SEQ ID NO: 11682 - RNA, 3822 nt, synthetic construct
  misc_feature 1..3822: note = SARS-CoV-2/England/200990660/2020__EPI_ISL_414523 spike protein CDS wt (1-1273)
  source 1..3822: mol_type = other RNA
atgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcagggtgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagctagtgctcaaaggagtcaaattacattacacataa

SEQ ID NO: 11683 - RNA, 3822 nt, synthetic construct
  misc_feature 1..3822: note = SARS-CoV-2/Australia/NSW09/2020__EPI_ISL_413595 spike protein CDS wt (1-1273)
  source 1..3822: mol_type = other RNA
atgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcaggatgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttctttcacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataa

SEQ ID NO: 11684 - RNA, 3822 nt, synthetic construct
  misc_feature 1..3822: note = SARS-CoV-2/Australia/NSW10/2020__EPI_ISL_413596 spike protein CDS wt (1-1273)
  source 1..3822: mol_type = other RNA
atgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcaggatgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgcttcaaatttgatgaagacgactctgagccagtgctcaaaggagtcaaattacattacacataa

SEQ ID NO: 11685 - RNA, 3822 nt, synthetic construct
  misc_feature 1..3822: note SARS-CoV-2/Switzerland/1000477797/2020__EPI_ISL_413023 spike protein CDS wt (1-1273)
  source 1..3822: mol_type = other RNA
atgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaacatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcagggtgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataa

SEQ ID NO: 11686 - RNA, 3822 nt, synthetic construct
  misc_feature 1..3822: note = SARS-CoV-2/Belgium/BA-02291/2020__EPI_ISL_415159 spike protein CDS wt (1-1273)
  source 1..3822: mol_type = other RNA
atgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaggtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacctgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcagggtgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttctgcagcacctgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataa

SEQ ID NO: 11687 - RNA, 3822 nt, synthetic construct
  misc_feature 1..3822: note = SARS-CoV-2/USA/WA8-UW5/2020__EPI_ISL_413486 spike protein CDS wt (1-1273)
  source 1..3822: mol_type = other RNA
atgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcaggatgttaactgcacagaagtccctgttgctattcatgcagatcaacttactcctacttggcgtgtttattctacaggttctaatgtttttcaaacacgtgcaggctgtttaataggggctgaatatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataa

SEQ ID NO: 11688 - RNA, 3822 nt, synthetic construct
  misc_feature 1..3822: note = SARS-CoV-2/England/20102000506/2020__EPI_ISL_415147 spike protein CDS wt (1-1273)
  source 1..3822: mol_type = other RNA
atgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcagggtgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggttattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataa

SEQ ID NO: 11689 - RNA, 3822 nt, synthetic construct
  misc_feature 1..3822: note = SARS-CoV-2/Belgium/VAG-03013/2020__EPI_ISL_415155 spike protein CDS wt (1-1273)
  source 1..3822: mol_type = other RNA
atgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcagggtgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaactgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataa

SEQ ID NO: 11690 - RNA, 3822 nt, synthetic construct
  misc_feature 1..3822: note = SARS-CoV-2/Belgium/BC-03016/2020__EPI_ISL_415157 spike protein CDS wt (1-1273)
  source 1..3822: mol_type = other RNA
atgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcagggtgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcacctgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataa

SEQ ID NO: 11691 - RNA, 3822 nt, synthetic construct
  misc_feature 1..3822: note = SARS-CoV-2/Germany/BavPat3/2020__EPI_ISL_414521 spike protein CDS wt (1-1273)
  source 1..3822: mol_type = other RNA
atgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcaggatgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaacaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataa

SEQ ID NO: 11692 - RNA, 3822 nt, synthetic construct
  misc_feature 1..3822: note = SARS-CoV-2/France/HF1805/2020__EPI_ISL_414628 spike protein CDS wt (1-1273)
  source 1..3822: mol_type = other RNA
atgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcagggtgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggagttgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataa

SEQ ID NO: 11693 - RNA, 3822 nt, synthetic construct
  misc_feature 1..3822: note SARS-CoV-2/Netherlands/ZuidHolland_9/2020__EPI_ISL_414445 spike protein CDS wt (1-1273)
  source 1..3822: mol_type = other RNA
atgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcagggtgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgtacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataa

SEQ ID NO: 11694 - RNA, 3822 nt, synthetic construct
  misc_feature 1..3822: note = SARS-CoV-2/Finland/FIN03032020A/2020__EPI_ISL_413602 spike protein CDS wt (1-1273)
  source 1..3822: mol_type = other RNA
atgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatatcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcagggtgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataa

SEQ ID NO: 11695 - RNA, 3822 nt, synthetic construct
  misc_feature 1..3822: note = SARS-CoV-2/France/GE1977/2020__EPI_ISL_414632 spike protein CDS wt (1-1273)
  source 1..3822: mol_type = other RNA
atgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcagggtgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcacttttttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataa

SEQ ID NO: 11696 - RNA, 3822 nt, synthetic construct
  misc_feature 1..3822: note = SARS-CoV-2/Finland/FIN-313/2020__EPI_ISL_414641 spike protein CDS wt (1-1273)
  source 1..3822: mol_type = other RNA
atgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttaaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcagggtgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatctatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataa

SEQ ID NO: 11697 - RNA, 3822 nt, synthetic construct
  misc_feature 1..3822: note SARS-CoV-2/Netherlands/ZuidHolland_2/2020__EPI_ISL_414556 spike protein CDS wt (1-1273)
  source 1..3822: mol_type = other RNA
atgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcagggtgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctcttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataa

SEQ ID NO: 11698 - RNA, 3822 nt, synthetic construct
  misc_feature 1..3822: note = SARS-CoV-2/USA/WA-UW31/2020__EPI_ISL_414618 spike protein CDS wt (1-1273)
  source 1..3822: mol_type = other RNA
atgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgctgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcaggatgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataa

SEQ ID NO: 11699 - RNA, 3822 nt, synthetic construct
  misc_feature 1..3822: note = SARS-CoV-2/South Korea/SNU01/2020__EPI_ISL_411929 spike protein CDS wt (1-1273)
  source 1..3822: mol_type = other RNA
atgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttgggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcaggatgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataa

SEQ ID NO: 11700 - RNA, 3822 nt, synthetic construct
  misc_feature 1..3822: note = SARS-CoV-2/China/WF0004/2020__EPI_ISL_413694 spike protein CDS wt (1-1273)
  source 1..3822: mol_type = other RNA
atgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggacggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcaggatgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagatttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataa

SEQ ID NO: 11701 - RNA, 3822 nt, synthetic construct
  misc_feature 1..3822: note = SARS-CoV-2/China/WF0028/2020__EPI_ISL_413791 spike protein CDS wt (1-1273)
  source 1..3822: mol_type = other RNA
atgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcaggatgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagaatcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataa

SEQ ID NO: 11702 - RNA, 3822 nt, synthetic construct
  misc_feature 1..3822: note = SARS-CoV-2/2019-nCoV/USA-CruiseA-18/2020__MT159716.1 spike protein CDS wt (1-1273)
  source 1..3822: mol_type = other RNA
atgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttaagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcaggatgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataa

SEQ ID NO: 11703 - RNA, 3822 nt, synthetic construct
  misc_feature 1..3822: note SARS-CoV-2/SARS-CoV-2/Yunnan-01/human/2020/CHN__MT049951.1 spike protein CDS wt (1-1273)
  source 1..3822: mol_type = other RNA
atgtttgtttttcttgttttattgccactagtctctagtcagtgtgttaatcttacaaccagaactcaattaccccctgcaaacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcaggatgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataa

SEQ ID NO: 11704 - RNA, 3822 nt, synthetic construct
  misc_feature 1..3822: note = SARS-CoV-2/USA/WA-UW292/2020__EPI_ISL_418077 spike protein CDS wt (1-1273)
  source 1..3822: mol_type = other RNA
atgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccagtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcaggatgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataa

SEQ ID NO: 11705 - RNA, 3822 nt, synthetic construct
  misc_feature 1..3822: note = SARS-CoV-2/Iceland/192/2020__EPI_ISL_417819 spike protein CDS wt (1-1273)
  source 1..3822: mol_type = other RNA
atgtttgttttttttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcagggtgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataa

SEQ ID NO: 11706 - RNA, 3822 nt, synthetic construct
  misc_feature 1..3822: note = SARS-CoV-2/Belgium/ULG-6939/2020__EPI_ISL_417020 spike protein CDS wt (1-1273)
  source 1..3822: mol_type = other RNA
atgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcagggtgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgtttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataa

SEQ ID NO: 11707 - RNA, 3822 nt, synthetic construct
  misc_feature 1..3822: note = SARS-CoV-2/France/HF2496/2020__EPI_ISL_418231 spike protein CDS wt (1-1273)
  source 1..3822: mol_type = other RNA
atgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcagggtgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgttgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataa

SEQ ID NO: 11708 - RNA, 3822 nt, synthetic construct
  misc_feature 1..3822: note = SARS-CoV-2/USA/WA-UW291/2020__EPI_ISL_418076 spike protein CDS wt (1-1273)
  source 1..3822: mol_type = other RNA
atgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcagggtgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaatactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataa

SEQ ID NO: 11709 - RNA, 3822 nt, synthetic construct
  misc_feature 1..3822: note = SARS-CoV-2/Portugal/PT0034/2020__EPI_ISL_418019 spike protein CDS wt (1-1273)
  source 1..3822: mol_type = other RNA
atgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcagggtgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtattaccagttgctgtagttgtctcaagggctgttgttcttgtggatcctgctgcaaatttgatgaagacgactctgagccagtgctcaaaggagtcaaattacattacacataa

SEQ ID NO: 11710 - RNA, 3822 nt, synthetic construct
  misc_feature 1..3822: note = SARS-CoV-2/Iceland/202/2020__EPI_ISL_417750 spike protein CDS wt (1-1273)
  source 1..3822: mol_type = other RNA
atgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcaggatgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatccctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataa

SEQ ID NO: 11711 - RNA, 3822 nt, synthetic construct
  misc_feature 1..3822: note = SARS-CoV-2/USA/WA-UW261/2020__EPI_ISL_418046 spike protein CDS wt (1-1273)
  source 1..3822: mol_type = other RNA
atgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttacatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcaggatgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataa

SEQ ID NO: 11712 - RNA, 3822 nt, synthetic construct
  misc_feature 1..3822: note = SARS-CoV-2/Portugal/PT0035/2020__EPI_ISL_418020 spike protein CDS wt (1-1273)
  source 1..3822: mol_type = other RNA
atgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcaggatgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatatttctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataa

SEQ ID NO: 11713 - RNA, 3822 nt, synthetic construct
  misc_feature 1..3822: note = SARS-CoV-2/USA/NY-NYUMC7/2020__EPI_ISL_418192 spike protein CDS wt (1-1273)
  source 1..3822: mol_type = other RNA
atgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttatcaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcagggtgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataa

SEQ ID NO: 11714 - RNA, 3822 nt, synthetic construct
  misc_feature 1..3822: note = SARS-CoV-2/Iceland/189/2020__EPI_ISL_417709 spike protein CDS wt (1-1273)
  source 1..3822: mol_type = other RNA
atgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcagggtgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcaccaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataa

SEQ ID NO: 11715 - RNA, 3822 nt, synthetic construct
  misc_feature 1..3822: note = SARS-CoV-2/Australia/NSW56/2020__EPI_ISL_417408 spike protein CDS wt (1-1273)
  source 1..3822: mol_type = other RNA
atgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcaggatgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagattcatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataa

SEQ ID NO: 11716 - RNA, 3822 nt, synthetic construct
  misc_feature 1..3822: note = SARS-CoV-2/Iceland/280/2020__EPI_ISL_417608 spike protein CDS wt (1-1273)
  source 1..3822: mol_type = other RNA
atgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcagggtgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcatactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataa

SEQ ID NO: 11717 - RNA, 3822 nt, synthetic construct
  misc_feature 1..3822: note = SARS-CoV-2/Iceland/247/2020__EPI_ISL_417575 spike protein CDS wt (1-1273)
  source 1..3822: mol_type = other RNA
atgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcagggtgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaattgtgacaattatgctttgctgtatgaccagttgctgtagttgtctcaagggctgttgttcttgtggatcctgctgcaaatttgatgaagacgactctgagccagtgctcaaaggagtcaaattacattacacataa

SEQ ID NO: 11718 - RNA, 3822 nt, synthetic construct
  misc_feature 1..3822: note = SARS-CoV-2/Iceland/238/2020__EPI_ISL_417566 spike protein CDS wt (1-1273)
  source 1..3822: mol_type = other RNA
atgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcagggtgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgttggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataa

SEQ ID NO: 11719 - RNA, 3822 nt, synthetic construct
  misc_feature 1..3822: note = SARS-CoV-2/Greece/16/2020__EPI_ISL_418265 spike protein CDS wt (1-1273)
  source 1..3822: mol_type = other RNA
atgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatgttgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcaggatgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataa

SEQ ID NO: 11720 - RNA, 3822 nt, synthetic construct
  misc_feature 1..3822: note = SARS-CoV-2/Iceland/319/2020__EPI_ISL_417648 spike protein CDS wt (1-1273)
  source 1..3822: mol_type = other RNA
atgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatagaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcagggtgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataa

SEQ ID NO: 11721 - RNA, 3822 nt, synthetic construct
  misc_feature 1..3822: note = SARS-CoV-2/Congo/94/2020__EPI_ISL_417947 spike protein CDS wt (1-1273)
  source 1..3822: mol_type = other RNA
atgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcagggtgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatatacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataa

SEQ ID NO: 11722 - RNA, 3822 nt, synthetic construct
  misc_feature 1..3822: note = SARS-CoV-2/Congo/158/2020__EPI_ISL_417950 spike protein CDS wt (1-1273)
  source 1..3822: mol_type = other RNA
atgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcaggatgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttttgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataa

SEQ ID NO: 11723 - RNA, 3822 nt, synthetic construct
  misc_feature 1..3822: note = SARS-CoV-2/USA/UT-00034/2020__EPI_ISL_417977 spike protein CDS wt (1-1273)
  source 1..3822: mol_type = other RNA
atgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattactacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcagggtgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataa

SEQ ID NO: 11724 - RNA, 3822 nt, synthetic construct
  misc_feature 1..3822: note = SARS-CoV-2/USA/UT-00033/2020__EPI_ISL_417976 spike protein CDS wt (1-1273)
  source 1..3822: mol_type = other RNA
atgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggtttgacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcagggtgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataa

SEQ ID NO: 11725 - RNA, 3822 nt, synthetic construct
  misc_feature 1..3822: note = SARS-CoV-2/USA/WI-13/2020__EPI_ISL_417516 spike protein CDS wt (1-1273)
  source 1..3822: mol_type = other RNA
atgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtcctaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcagggtgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataa

SEQ ID NO: 11726 - RNA, 3819 nt, synthetic construct
  misc_feature 1..3819: note = SARS-CoV-2/India/1-27/2020__EPI_ISL_413522 spike protein CDS wt (1-1272)
  source 1..3819: mol_type = other RNA
atgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcatacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcaggatgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataa

SEQ ID NO: 11727 - RNA, 3804 nt, synthetic construct
  misc_feature 1..3804: note = SARS-CoV-2/pangolin/Guangxi/P4L/2017__EPI_ISL_410538 spike protein CDS wt (1-1267)
  source 1..3804: mol_type = other RNA
atgtttgtttttctttttgtcttgcctttggtttccagtcaatgtgtcaatttgaccacaagaactggaataccgccaggttataccaattcatctactagaggtgtctattatccagacaaagtttttaggtcttcaattttacatcttacacaagaccttttcttacctttcttttctaatgttacttggtttaacaccataaattatcaaggaggctttaagaagtttgacaatcctgttttaccatttaatgatggtgtttactttgcctccacggaaaagtccaatattatacgcggttggatttttggaacaacacttgatgccagaactcaatctcttctaatagttaacaacgcaaccaatgttgttatcaaagtatgtgagtttcagttttgcactgatccatttttaggtgtttactatcataacaacaataaaacatgggttgaaaatgagtttagagtttattcaagtgccaacaattgcactttcgaatacatttctcaaccttttcttatggaccttgaaggaaagcaaggtaattttaagaaccttagagagtttgtgtttaaaaatgttgatggttatttcaagatttactctaaacacacacctattgatttagtgcgcgacctccccagaggttttgctgcattggaaccactggtggacctccctataggtattaatattaccagattccaaacattgcttgctttacatagaagttatcttacacctggtaatctagaaagtggctggacaactggagctgctgcttactatgtaggttacctacaacagaggacttttctcttaagttacaatcaaaatggaaccattacagatgctgttgattgttcactagaccctctttcagagacaaagtgcacattaaaatccctaacagttgaaaaaggaatttaccagacttctaacttcagagttcaaccaacaatcagtatagttagatttcctaatattacaaacttatgtccatttggagaagtgtttaacgcatccaaatttgcatcagtttatgcttggaacaggaagagaattagcaattgtgttgctgattactctgtactttataactctacatcattttccacttttaaatgttatggagtttcacctacaaaactcaatgacctttgcttcaccaatgtgtatgcagactcatttgttgttaaaggtgacgaggttagacaaatagcacccggacaaactggtgttattgctgattataactataagctgccagatgattttactggttgtgttattgcttggaactcagttaagcaagatgctttgactggtggtaattatggttatttgtatagattatttagaaagtctaagcttaaaccatttgagagagatatttccactgaaatataccaagccggcagcacaccctgtaacggtcaagttggtctaaattgttattatcctcttgaaaggtatggttttcacccaactacaggtgttaactaccaaccttttagagtggttgttttatcatttgagttacttaatggaccagctactgtttgtggacccaaattgtctacaacactagttaaagacaaatgtgtcaatttcaactttaacggtttaactggcacaggtgttcttacaacatctaagaaacagtttctgccttttcaacaatttggtagagacatctctgacactactgatgctgtccgtgacccacagacacttgaaatacttgacattaccccttgctcttttggaggagttagtgtgataacaccaggtacaaacacttctaatcaagtggctgtactttaccaagatgttaactgtactgaagtgcctatggccattcatgcagaacaacttacacctgcctggcgtgtttactctgcaggagcaaatgtgtttcaaacaagagcaggctgtttagtaggtgctgagcatgtcaacaattcttatgaatgtgacattccagtcggtgctggcatatgtgcaagttaccattccatgtcatcattgcgtagtgtcaaccagcgttcaatcattgcttacactatgtctttaggtgcagaaaattcagttgcttattctaataattcaattgccatacctactaattttacaataagtgttaccacagaaattctaccagtgtcaatgactaagacttctgtagattgtactatgtacatctgtggagattcaattgagtgtagtaatttattgctacaatatggcagtttttgcacacaattaaaccgtgctttgactgggattgctgttgaacaagacaaaaacacacaagaagtttttgcccaggttaaacaaatctacaaaacaccacctattaaagattttggtggctttaacttttcacaaatattgccagatccatcaaaaccaagcaagaggtcatttattgaggatttactcttcaacaaagtgacacttgctgatgctggcttcatcaaacaatatggtgattgccttggtgatattgctgctagagatctcatctgtgcacaaaagttcaatggactcacggttctaccgcctttgctcacagatgaaatgattgctcaatacacttctgcactacttgctggaacaatcacctcaggttggacctttggtgcaggagctgctttacaaataccctttgcaatgcaaatggcttacaggtttaatggcattggagtcactcagaatgttctatatgagaatcagaaattaattgccaatcagttcaacagtgctattggcaaaatacaggattcactttcatctacggctagtgcacttggtaaacttcaagacgtcgtaaatcaaaatgcacaggctttaaacacacttgtcaaacaacttagttccaattttggagctatttcgagtgtgcttaatgatattctttcacgtcttgacaaagttgaggctgaagtgcaaattgataggttaatcacaggaagactacagagtcttcaaacttatgtgacacaacaattaatcagagcagcagaaatcagagcttctgctaatcttgctgcaacaaaaatgtctgagtgcgtactcggacaatctaaaagagttgatttttgtggaaaaggctaccatttaatgtctttccctcaatcagcaccgcatggtgttgttttcttgcatgttacttatgtacctgcacaagaaaagaactttactactgctcctgctatttgtcatgaaggaaaagcacacttccctcgtgaaggtgtcttcgtttcaaatggcactcattggtttattacacaaaggaatttttatgaacctcaaattattaccactgacaacacattcgtctctggtagctgtgatgttgtaattggaatagtcaacaacacagtttatgatcctttgcaacccgagcttgactcatttaaggaggagttagacaaatacttcaaaaatcacacatcaccagatgttgatcttggcgacatatctggcataaatgcttcggtcgtcaacatacaaaaagaaattgaccgcctcaatgaggttgccaaaaatttgaatgaatcacccattgacctacaagagcttggaaaatatgagcaatacatcaaatggccttggtacatttggcttggttttatagctgggctaattgctatcattatggtcacaatcatgctatgttgtatgactagttgctgtagttgcctcaagggttgttgctcttgcggttcctgctgcaaatttgatgaagacgattcagaacctgttctgaaaggagtcaaattacattacacataa

SEQ ID NO: 11728 - RNA, 3804 nt, synthetic construct
  misc_feature 1..3804: note = SARS-CoV-2/pangolin/Guangxi/P5L/2017__EPI_ISL_410540 spike protein CDS wt (1-1267)
  source 1..3804: mol_type = other RNA
atgtttgtttttctttttgtcttgcctttggtttccagtcaatgtgtcaatttgaccacaagaactggaataccgccaggttataccaattcatctactagaggtgtctattatccagacaaagtttttaggtcttcaattttacatcttacacaagaccttttcttacctttcttttctaatgttacttggtttaacaccataaattatcaaggaggctttaagaagtttgacaatcctgttttaccatttaatgatggtgtttactttgcctccacggaaaagtccaatattatacgcggttggatttttggaacaacacttgatgccagaactcaatctcttctaatagttaacaacgcaaccaatgttgttatcaaagtatgtgagtttcagttttgcactgatccatttttaggtgtttactatcataacaacaataaaacatgggttgaaaatgagtttagagtttattcaagtgccaacaattgcactttcgaatacatttctcaaccttttcttatggaccttgaaggaaagcaaggtaattttaagaaccttagagagtttgtgtttaaaaatgttgatggttatttcaagatttactctaaacacacacctattgatttagtgcgcgacctccccagaggttttgctgcattggaaccactggtggacctccctataggtattaatattaccagattccaaacattgcttgctttacatagaagttatcttacacctggtaagctagaaagtggctggacaactggagctgctgcttactatgtaggttacctacaacagaggacttttctcttaagttacaatcaaaatggaaccattacagatgctgttgattgttcactagaccctctttcagagacaaagtgcacattaaaatccctaacagttgaaaaaggaatttaccagacttctaacttcagagttcaaccaacaatcagtatagttagatttcctaatattacaaacttatgtccatttggagaagtgtttaacgcatccaaatttgcatcagtttatgcttggaacaggaagagaattagcaattgtgttgctgattactctgtactttataactctacatcattttccacttttaaatgttatggagtttcacctacaaaactcaatgacctttgcttcaccaatgtgtatgcagactcatttgttgttaaaggtgacgaggttagacaaatagcacccggacaaactggtgttattgctgattataactataagctgccagatgattttactggttgtgttattgcttggaactcagttaagcaagatgctttgactggtggtaattatggttatttgtatagattatttagaaagtctaagcttaaaccatttgagagagatatttccactgaaatataccaagccggcagcacaccctgtaacggtcaagttggtctaaattgttattatcctcttgaaaggtatggttttcacccaactacaggtgttaactaccaaccttttagagtggttgttttatcatttgagttacttaatggaccagctactgtttgtggacccaaattgtctacaacactagttaaagacaaatgtgtcaatttcaactttaacggtttaactggcacaggtgttcttacaacatctaagaaacagtttctgccttttcaacaatttggtagagacatctctgacactactgatgctgtccgtgacccacagacacttgaaatacttgacattaccccttgctcttttggaggagttagtgtgataacaccaggtacaaacacttctaatcaagtggctgtactttaccaagatgttaactgtactgaagtgcctatggccattcatgcagaacaacttacacctgcctggcgtgtttactctgcaggagcaaatgtgtttcaaacaagagcaggctgtttagtaggtgctgagcatgtcaacaattcttatgaatgtgacattccagtcggtgctggcatatgtgcaagttaccattccatgtcatcatttcgtagtgtcaaccagcgttcaatcattgcttacactatgtctttaggtgcagaaaattcagttgcttattctaataattcaattgccatacctactaattttacaataagtgttaccacagaaattctaccagtgtcaatgactaagacttctgtagattgtactatgtacatctgtggagattcaattgagtgtagtaatttattgctacaatatggcagtttttgcacacaattaaaccgtgctttgactgggattgctgttgaacaagacaaaaacacacaagaagtttttgcccaggttaaacaaatctacaaaacaccacctattaaagattttggtggctttaacttttcacaaatattgccagatccatcaaaaccaagcaagaggtcatttattgaggatttactcttcaacaaagtgacacttgctgatgctggcttcatcaaacaatatggtgattgccttggtgatattgctgctagagatctcatctgtgcacaaaagttcaatggactcacggttctaccgcctttgctcacagatgaaatgattgctcaatacacttctgcactacttgctggaacaatcacctcaggttggacctttggtgcaggagctgctttacaaataccctttgcaatgcaaatggcttacaggtttaatggcattggagtcactcagaatgttctatatgagaatcagaaattaattgccaatcagttcaacagtgctattggcaaaatacaggattcactttcatctacggctagtgcacttggtaaacttcaagacgtcgtaaatcaaaatgcacaggctttaaacacacttgtcaaacaacttagttccaattttggagctatttcgagtgtgcttaatgatattctttcacgtcttgacaaagttgaggctgaagtgcaaattgataggttaatcacaggaagactacagagtcttcaaacttatgtgacacaacaattaatcagagcagcagaaatcagagcttctgctaatcttgctgcaacaaaaatgtctgagtgcgtactcggacaatctaaaagagttgatttttgtggaaaaggctaccatttaatgtctttccctcaatcagcaccgcatggtgttgttttcttgcatgttacttatgtacctgcacaagaaaagaactttactactgctcctgctatttgtcatgaaggaaaagcacacttccctcgtgaaggtgtcttcgtttcaaatggcactcattggtttattacacaaaggaatttttatgaacctcaaattattaccactgacaacacattcgtctctggtagctgtgatgttgtaattggaatagtcaacaacacagtttatgatcctttgcaacccgagcttgactcatttaaggaggagttagacaaatacttcaaaaatcacacatcaccagatgttgatcttggcgacatatctggcataaatgcttcggtcgtcaacatacaaaaagaaattgaccgcctcaatgaggttgccaaaaatttgaatgaatcactcattgacctacaagagcttggaaaatatgagcaatacatcaaatggccttggtacatttggcttggttttatagctgggctaattgctatcattatggtcacaatcatgctatgttgtatgactagttgctgtagttgcctcaagggttgttgctcttgcggttcctgctgcaaatttgatgaagacgattcagaacctgttctgaaaggagtcaaattacattacacataa

SEQ ID NO: 11729 - RNA, 3804 nt, synthetic construct
  misc_feature 1..3804: note = SARS-CoV-2/pangolin/Guangxi/P5E/2017__EPI_ISL_410541 spike protein CDS wt (1-1267)
  source 1..3804: mol_type = other RNA
atgtttgtttttctttttgtcttgcctttggtttccagtcaatgtgtcaatttgaccacaagaactggaataccgccaggttataccaattcatctactagaggtgtctattatccagacaaagtttttaggtcttcaattttacatcttacacaagaccttttcttacctttcttttctaatgttacttggtttaacaccataacttatcaaggaggctctaagaagtttgacaatcctgttttaccatttaatgatggtgtttactttgcctccacggaaaagtccaatattatacgcggttggatttttggaacaacacttgatgccagaactcaatctcttctaatagttaacaacgcaaccaatgttgttatcaaagtatgtgagtttcagttttgcactgatccatttttaggtgtttactatcataacaacaataaaacatgggttgaaaatgagtttagagtttattcaagtgccaacaattgcactttcgaatacatttctcaaccttttcttatggaccttgaaggaaagcaaggtaattttaagaaccttagagagtttgtgtttaaaaatgttgatggttatttcaagatttactctaaacacacacctattgatttagtgcgcgacctccccagaggttttgctgcattggaaccactggtggacctccctataggtattaatattaccagattccaaacattgcttgctttacatagaagttatcttacacctggtaagctagaaagtggctggacaactggagctgctgcttactatgtaggttacctacaacagaggacttttctcttaagttacaatcaaaatggaaccattacagatgctgttgattgttcactagaccctctttcagagacaaagtgcacattaaaatccctaacagttgaaaaaggaatttaccagacttctaacttcagagttcaaccaacaatcagtatagttagatttcctaatattacaaacttatgtccatttggagaagtgtttaacgcatccaaatttgcatcagtttatgcttggaacaggaagagaattagcaattgtgttgctgattactctgtactttataactctacatcattttccacttttaaatgttatggagtttcacctacaaaactcaatgacctttgcttcaccaatgtgtatgcagactcatttgttgttaaaggtgacgaggttagacaaatagcacccggacaaactggtgttattgctgattataactataagctgccagatgattttactggttgtgttattgcttggaactcagttaagcaagatgctttgactggtgataattatggttatttgtatagattatttagaaagtctaagcttaaaccatttgagagagatatttccactgaaatataccaagccggcagcacaccctgtaacggtcaagttggtctaaattgttattatcctcttgaaaggtatggttttcacccaactacaggtgttaactaccaaccttttagagtggttgttttatcatttgagttacttaatggaccagctactgtttgtggacccaaattgtctacaacactagttaaagacaaatgtgtcaatttcaactttaacggtttaactggcacaggtgttcttacaacatctaagaaacagtttctgccttttcaacaatttggtagagacatctctgacactactgatgctgtccgtgacccacagacacttgaaatacttgacattaccccttgctcttttggaggagttagtgtgataacaccaggtacaaacacttctaatcaagtggctgtactttaccaagatgttaactgtactgaagtgcctatggccattcatgcagaacaacttacacctgcctggcgtgtttactctgcaggagcaaatgtgtttcaaacaagagcaggctgtttagtaggtgctgagcatgtcaacaattcttatgaatgtgacattccagtcggtgctggcatatgtgcaagttaccattccatgtcatcatttcgtagtgtcaaccagcgttcaatcattgcttacactatgtctttaggtgcagaaaattcagttgcttattctaataattcaattgccatacctactaattttacaataagtgttaccacagaaattctaccagtgtcaatgactaagacttctgtagattgtactatgtacatctgtggagattcaattgagtgtagtaatttattgctacaatatggcagtttttgcacacaattaaaccgtgctttgactgggattgctgttgaacaagacaaaaacacacaagaagtttttgcccaggttaaacaaatctacaaaacaccacctattaaagattttggtggctttaacttttcacaaatattgccagatccatcaaaaccaagcaagaggtcatttattgaggatttactcttcaacaaagtgacacttgctgatgctggcttcatcaaacaatatggtgattgccttggtgatattgctgctagagatctcatctgtgcacaaaagttcaatggactcacggttctaccgcctttgctcacagatgaaatgattgctcaatacacttctgcactacttgctggaacaatcacctcaggttggacctttggtgcaggagctgctttacaaataccctttgcaatgcaaatggcttacaggtttaatggcattggagtcactcagaatgttctatatgagaatcagaaattaattgccaatcagttcaacagtgctattggcaaaatacaggattcactttcatctacggctagtgcacttggtaaacttcaagacgtcgtaaatcaaaatgcacaggctttaaacacacttgtcaaacaacttagttccaattttggagctatttcgagtgtgcttaatgatattctttcacgtcttgacaaagttgaggctgaagtgcaaattgataggttaatcacaggaagactacagagtcttcaaacttatgtgacacaacaattaatcagagcagcagaaatcagagcttctgctaatcttgctgcaacaaaaatgtctgagtgcgtactcggacaatctaaaagagttgatttttgtggaaaaggctaccatttaatgtctttccctcaatcagcaccgcatggtgttgttttcttgcatgttacttatgtacctgcacaagaaaagaactttactactgctcctgctatttgtcatgaaggaaaagcacacttccctcgtgaaggtgtcttcgtttcaaatggcactcattggtttattacacaaaggaatttttatgaacctcaaattattaccactgacaacacattcgtctctggtagctgtgatgttgtaattggaatagtcaacaacacagtttatgatcctttgcaacccgagcttgactcatttaaggaggagttagacaaatacttcaaaaatcacacatcaccagatgttgatcttggcgacatatctggcataaatgcttcggtcgtcaacatacaaaaagaaattgaccgcctcaatgaggttgccaaaaatttgaatgaatcactcattgacctacaagagcttggaaaatatgagcaatacatcaaatggccttggtacatttggcttggttttatagctgggctaattgctatcattatggtcacaatcatgctatgttgtatgactagttgctgtagttgcctcaagggttgttgctcttgcggttcctgctgcaaatttgatgaagacgattcagaacctgttctgaaaggagtcaaattacattacacataa

SEQ ID NO: 11730 - RNA, 3798 nt, synthetic construct
  misc_feature 1..3798: note = SARS-CoV-2/pangolin/Guangxi/P1E/2017__EPI_ISL_410539 spike protein CDS wt (1-1265)
  source 1..3798: mol_type = other RNA
atgtttgtttttctttttgtcttgcctttggtttccagtcaatgtgtcaatttgaccacaagaactggaatacagccaggttataccaattcatctactagaggtgtctattatccagacaaagtttttaggtcttcaattttacatcttacacaagaccttttcttacctttcttttctaatgttacttggtttaacaccataaattatcaaggaggctttaagaagtttgacaatcctgttttaccatttaatgatggtgtttactttgcctccacggaaaagtccaatattatacgcggttggatttttggaacaacacttgatgccagaactcaatctcttctaatagttaacaacgcaaccaatgttgttatcaaagtatgtgagtttcagttttgcactgatccatttttaggtgtttactatcataacaacaataaaacatgggttgaaaatgagtttagagtttattcaagtgccaacaattgcactttcgaatacatttctcaaccttttcttatggaccttgaaggaaagcaaggtaattttaagaaccttagagagtttgtgtttaaaaatgttgatggttatttcaagatttactctaaacacacacctattgatttagtgcgcgacctccccagaggttttgctgcattggaaccactggtggacctccctataggtattaatattaccagattccaaacattgcttgctttacatagaagttatcttacacctggtaagctagaaagtggctggacaactggagctgctgcttactatgtaggttacctacaacagaggacttttctcttaagttacaatcaaaatggaaccattacagatgctgttgattgttcactagaccctctttcagagacaaagtgcacattaaaatccctaacagttgaaaaaggaatttaccagacttctaacttcagagttcaaccaacaatcagtatagttagatttcctaatattacaaacttatgtccatttggagaagtgtttaacgcatccaaatttgcatcagtttatgcttggaacaggaagagaattagcaattgtgttgctgattactctgtactttataactctacatcattttccacttttaaatgttatggagtttcacctacaaaactcaatgacctttgcttcaccaatgtgtatgcagactcatttgttgttaaaggtgacgaggttagacaaatagcacccggacaaactggtgttattgctgattataactataagctgccagatgattttactggttgtgttattgcttggaactcagttaagcaagatgctttgactggtggtaattatttgtatagattatttagaaagtctaagcttaaaccatttgagagagatatttccactgaaatataccaagccggcagcacaccctgtaacggtcaagttggtctaaattgttattatcctcttgaaaggtatggttttcacccaactacaggtgttaactaccaaccttttagagtggttgttttatcatttgagttacttaatggaccagctactgtttgtggacccaaattgtctacaacactagttaaagacaaatgtgtcaatttcaactttaacggtttaactggcacaggtgttcttacaacatctaagaaacagtttctgccttttcaacaatttggtagagacatctctgacactactgatgctgtccgtgacccacagacacttgaaatacttgacattaccccttgctcttttggaggagttagtgtgataacaccaggtacaaacacttctaatcaagtggctgtactttaccaagatgttaactgtactgaagtgcctatggccattcatgcagaacaacttacacctgcctggcgtgtttactctgcaggagcaaatgtgtttcaaacaagagcaggctgtttagtaggtgctgagcatgtcaacaattcttatgaatgtgacattccagtcggtgctggcatatgtgcaagttaccattccatgtcatcattgcgtagtgtcaaccagcgttcaatcattgcttacactatgtctttaggtgcagaaaattcagttgcttattctaataattcaattgccatacctactaattttacaataagtgttaccacagaaattctaccagtgtcaatgactaagacttctgtagattgtactatgtacatctgtggagattcaattgagtgtagtaatttattgctacaatatggcagtttttgcacacaattaaaccgtgctttgactgggattgctgttgaacaagacaaaaacacacaagaagtttttgcccaggttaaacaaatctacaaaacaccacctattaaagattttggtggctttaacttttcacaaatattgccagatccatcaaaaccaagcaagaggtcatttattgaggatttactcttcaacaaagtgacacttgctgatgctggcttcatcaaacaatatggtgattgccttggtgatattgctgctagagatctcatctgtgcacaaaagttcaatggactcacggttctaccgcctttgctcacagatgaaatgattgctcaatacacttctgcactacttgctggaacaatcacctcaggttggacctttggtgcaggagctgctttacaaataccctttgcaatgcaaatggcttacaggtttaatggcattggagtcactcagaatgttctatatgagaatcagaaattaattgccaatcagttcaacagtgctattggcaaaatacaggattcactttcatctacggctagtgcacttggtaaacttcaagacgtcgtaaatcaaaatgcacaggctttaaacacacttgtcaaacaacttagttccaattttggagctatttcgagtgtgcttaatgatattctttcacgtcttgacaaagttgaggctgaagtgcaaattgataggttaatcacaggaagactacagagtcttcaaacttatgtgacacaacaattaatcagagcagcagaaatcagagcttctgctaatcttgctgcaacaaaaatgtctgagtgcgtactcggacaatctaaaagagttgatttttgtggaaaaggctaccatttaatgtctttccctcaatcagcaccgcatggtgttgttttcttgcatgttacttatgtacctgcacaagaaaagaactttactactgctcctgctatttgtcatgaaggaaaagcacacttccctcgtgaaggtgtcttcgtttcaaatggcactcattggtttattacacaaaggaatttttatgaacctcaaattattaccactgacaacacattcgtctctggtagctgtgatgttgtaattggaatagtcaacaacacagtttatgatcctttgcaacccgagcttgactcatttaaggaggagttagacaaatacttcaaaaatcacacatcaccagatgttgatcttggcgacatatctggcataaatgcttcggtcgtcaacatacaaaaagaaattgaccgcctcaatgaggttgccaaaaatttgaatgaatcactcattgacctacaagagcttggaaaatatgagcaatacatcaaatggccttggtacatttggcttggttttatagctgggctaattgctatcattatggtcacaatcatgctatgttgtatgactagttgctgtagttgcctcaagggttgttgctcttgcggttcctgctgcaaatttgatgaagacgattcagaacctgttctgaaaggagtcaaattacattacacataa

SEQ ID NO: 11731 - RNA, 3822 nt, synthetic construct; identical to SEQ ID NO: 136
  misc_feature 1..3822: note = SARS-CoV-2/Wuhan/WIV05/2019__EPI_ISL_402128 spike protein CDS gc (1-1273)
  source 1..3822: mol_type = other RNA

SEQ ID NO: 11732 - RNA, 3810 nt, synthetic construct
  misc_feature 1..3810: note = SARS-CoV-2/bat/Yunnan/RaTG13/2013__EPI_ISL_402131 spike protein CDS gc (1-1269)
  source 1..3810: mol_type = other RNA
atgttcgtgttcctggtcctcctgcccctggtgagctcccagtgcgtgaacctcaccacccgcacgcagctgccgcccgcctacaccaacagctccacccggggcgtctactaccccgacaaggtgttccgcagctccgtgctgcacctcacccaggacctgttcctgcccttcttcagcaacgtcacgtggttccacgccatccacgtgtccgggaccaacggcatcaagcggttcgacaacccggtgctccccttcaacgacggggtctacttcgcgagcaccgagaagtccaacatcatccgcggctggatcttcgggaccacgctggacagcaagacccagtccctgctcatcgtgaacaacgccaccaacgtggtcatcaaggtgtgcgagttccagttctgcaacgaccccttcctgggcgtgtactaccacaagaacaacaagagctggatggagtccgagttccgggtctacagctccgccaacaactgcaccttcgagtacgtgagccagcccttcctgatggacctcgagggcaagcaggggaacttcaagaacctgcgcgagttcgtgttcaagaacatcgacggctacttcaagatctactccaagcacacgccgatcaacctggtccgggacctcccgcccgggttcagcgccctggagcccctggtggacctccccatcggcatcaacatcacccgcttccagaccctgctggccctccaccggtcctacctgacccccggggacagcagctccggctggacggcgggcgccgccgcctactacgtggggtacctgcagccccgcaccttcctcctgaagtacaacgagaacggcaccatcaccgacgcggtcgactgcgccctggaccccctcagcgagacgaagtgcaccctgaagtccttcaccgtggagaaggggatctaccagaccagcaacttccgggtgcagccgacggactccatcgtccgcttccccaacatcaccaacctgtgccccttcggcgaggtgttcaacgccaccaccttcgccagcgtctacgcctggaaccggaagcgcatctccaactgcgtggcggactacagcgtgctctacaactccacgagcttctccaccttcaagtgctacggcgtcagccccaccaagctgaacgacctgtgcttcaccaacgtgtacgccgactccttcgtgatcacgggggacgaggtccggcagatcgccccgggccagaccgggaagatcgccgactacaactacaagctccccgacgacttcaccggctgcgtgatcgcctggaacagcaagcacatcgacgcgaaggagggcgggaacttcaactacctgtaccgcctgttccggaaggccaacctcaagcccttcgagcgcgacatctccaccgagatctaccaggccggcagcaagccctgcaacgggcagacgggcctgaactgctactacccgctgtaccggtacgggttctaccccaccgacggcgtggggcaccagccctaccgcgtcgtggtgctctccttcgagctgctgaacgcccccgccaccgtctgcggcccgaagaagtccaccaacctcgtgaagaacaagtgcgtgaacttcaacttcaacggcctgaccgggacgggcgtcctgaccgagagcaacaagaagttcctgcccttccagcagttcgggcgggacatcgcggacaccaccgacgccgtgcgcgacccccagacgctcgagatcctggacatcaccccgtgcagcttcggcggggtgagcgtcatcacccccggcaccaacgcctccaaccaggtggccgtgctgtaccaggacgtcaactgcacggaggtgcccgtggccatccacgcggaccagctcacccccacctggcgcgtctacagcaccggctccaacgtgttccagacgcgggccgggtgcctgatcggcgccgagcacgtgaacaacagctacgagtgcgacatcccgatcggggccggcatctgcgcgtcctaccagacccagaccaacagccgctccgtcgccagccagtccatcatcgcctacaccatgagcctgggcgccgagaactccgtggcctacagcaacaactccatcgcgatccccacgaacttcaccatcagcgtgaccaccgagatcctccccgtctccatgacgaagaccagcgtggactgcaccatgtacatctgcggggactccaccgagtgcagcaacctgctgctccagtacggcagcttctgcacgcagctgaaccgggccctgaccgggatcgccgtggagcaggacaagaacacccaggaggtcttcgcccaggtgaagcagatctacaagacgcccccgatcaaggacttcggcgggttcaacttctcccagatcctccccgaccccagcaagccctccaagcgcagcttcatcgaggacctgctgttcaacaaggtgaccctcgccgacgcgggcttcatcaagcagtacggcgactgcctgggggacatcgccgcccgggacctgatctgcgcccagaagttcaacggcctcaccgtcctgccgcccctgctcaccgacgagatgatcgcccagtacacctccgcgctgctggccgggacgatcaccagcggctggaccttcggggccggcgccgcgctccagatccccttcgccatgcagatggcctaccgcttcaacggcatcggggtgacccagaacgtgctgtacgagaaccagaagctgatcgccaaccagttcaactccgccatcggcaagatccaggacagcctctccagcacggcgtccgccctggggaagctgcaggacgtcgtgaaccagaacgcccaggccctcaacaccctggtgaagcagctgagctccaacttcggcgccatcagctccgtcctcaacgacatcctgagccggctggacaaggtggaggcggaggtgcagatcgaccgcctcatcaccgggcggctgcagtccctgcagacctacgtcacccagcagctcatccgcgccgccgagatccgggccagcgccaacctggcggccacgaagatgtccgagtgcgtgctgggccagagcaagcgcgtggacttctgcggcaaggggtaccacctcatgagcttcccccagtccgccccgcacggcgtcgtgttcctgcacgtgacctacgtccccgcccaggagaagaacttcaccaccgcgcccgccatctgccacgacgggaaggcccacttcccccgggagggcgtgttcgtcagcaacgggacgcactggttcgtgacccagcgcaacttctacgagccgcagatcatcaccaccgacaacacgttcgtgtccggcagctgcgacgtcgtgatcggcatcgtgaacaacaccgtctacgaccccctgcagcccgagctcgactccttcaaggaggagctggacaagtacttcaagaaccacaccagccccgacgtggacctgggggacatctccggcatcaacgccagcgtggtcaacatccagaaggagatcgaccggctcaacgaggtggccaagaacctgaacgagtccctgatcgacctccaggagctggggaagtacgagcagtacatcaagtggccgtggtacatctggctgggcttcatcgcgggcctcatcgccatcatcatggtgaccatcatgctgtgctgcatgacgagctgctgctcctgcctgaaggggtgctgcagctgcggctcctgctgcaagttcgacgaggacgacagcgagcccgtcctcaagggggtgaagctgcactacacctga

SEQ ID NO: 11733 - RNA, 3822 nt, synthetic construct
  misc_feature 1..3822: note = SARS-CoV-2/Wuhan/HBCDC-HB-01/2019__EPI_ISL_402132 spike protein CDS gc (1-1273)
  source 1..3822: mol_type = other RNA
atgttcgtgttcctggtcctcctgcccctggtgagctcccagtgcgtgaacctcaccacccgcacgcagctgccgcccgcctacaccaacagcatcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtga

SEQ ID NO: 11734 - RNA, 3822 nt, synthetic construct
  misc_feature 1..3822: note = SARS-CoV-2/Guangdong/20SF028/2020__EPI_ISL_403936 spike protein CDS gc (1-1273)
  source 1..3822: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgtactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtga

SEQ ID NO: 11735 - RNA, 3822 nt, synthetic construct
  misc_feature 1..3822: note = SARS-CoV-2/Shenzhen/SZTH-001/2020__EPI_ISL_406592 spike protein CDS gc (1-1273)
  source 1..3822: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtgctgatcggcatcgtcaacaacacggtgtacgaccccctgcagcccgagctcgactccttcaaggaggagctggacaagtacttcaagaaccacaccagccccgacgtggacctgggggacatctccggcatcaacgccagcgtcgtgaacatccagaaggagatcgaccgcctcaacgaggtggccaagaacctgaacgagtccctgatcgacctccaggagctggggaagtacgagcagtacatcaagtggccgtggtacatctggctgggcttcatcgccggcctcatcgcgatcgtcatggtgaccatcatgctgtgctgcatgaccagctgctgctcctgcctgaaggggtgctgcagctgcggctcctgctgcaagttcgacgaggacgacagcgggcccgtgctcaagggcgtcaagctgcactacacgtga

SEQ ID NO: 11736 - RNA, 3822 nt, synthetic construct
  misc_feature 1..3822: note = SARS-CoV-2/Shenzhen/SZTH-004/2020__EPI_ISL_406595 spike protein CDS gc (1-1273)
  source 1..3822: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctgggaccgcaagcggatctccaactgcgtggcgtactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtga

SEQ ID NO: 11737 - RNA, 3822 nt, synthetic construct
  misc_feature 1..3822: note = SARS-CoV-2/France/IDF0372/2020__EPI_ISL_406596 spike protein CDS gc (1-1273)
  source 1..3822: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcttcctgtacaactccgccagcttctccacgttcaagtgctacggcgtgagccccaccaagctcaacgacctgtgcttcaccaacgtctacgccgactccttcgtgatccgcggggacgaggtgcggcagatcgcccccggccagaccgggaagatcgccgactacaactacaagctgccggacgacttcacgggctgcgtcatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtggtcctgagcttcgagctcctgcacgcccccgccacggtgtgcggccccaagaagtccaccaacctggtgaagaacaagtgcgtcaacttcaacttcaacggcctcaccgggaccggcgtgctgaccgagagcaacaagaagttcctgccgttccagcagttcgggcgcgacatcgccgacacgaccgacgcggtgcgcgacccccagaccctggagatcctcgacatcaccccctgcagcttcggcggggtctccgtgatcacgccgggcaccaacaccagcaaccaggtggccgtcctgtaccaggacgtgaactgcaccgaggtgcccgtcgccatccacgccgaccagctgacgcccacctggcgggtgtactccaccggcagcaacgtgttccagacccgcgccgggtgcctcatcggcgcggagcacgtcaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtggcctactccaacaacagcatcgccatccccaccaacttcacgatctccgtcaccaccgagatcctgcccgtgagcatgaccaagacgagcgtggactgcaccatgtacatctgcggggactccaccgagtgcagcaacctcctgctgcagtacggctccttctgcacccagctcaaccgcgcgctgacggggatcgccgtcgagcaggacaagaacacccaggaggtgttcgcccaggtgaagcagatctacaagacgcccccgatcaaggacttcggcgggttcaacttcagccagatcctgcccgacccctccaagcccagcaagcggtccttcatcgaggacctcctgttcaacaaggtcaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtgacccagaacgtcctctacgagaaccagaagctgatcgccaaccagttcaacagcgccatcggcaagatccaggactccctgagctccaccgccagcgcgctcgggaagctgcaggacgtggtgaaccagaacgcccaggccctgaacacgctcgtcaagcagctgtccagcaacttcggcgccatctccagcgtgctgaacgacatcctctcccgcctggacaaggtggaggccgaggtccagatcgaccggctgatcaccgggcgcctccagagcctgcagacctacgtgacccagcagctgatccgggcggccgagatccgcgccagcgccaacctcgccgcgaccaagatgtccgagtgcgtgctgggccagagcaagcgggtcgacttctgcggcaaggggtaccacctgatgtccttcccccagagcgccccgcacggcgtggtgttcctccacgtcacgtacgtgcccgcccaggagaagaacttcaccaccgcccccgcgatctgccacgacgggaaggcccacttcccccgcgagggcgtcttcgtgtccaacgggacccactggttcgtgacgcagcggaacttctacgagccgcagatcatcaccaccgacaacaccttcgtcagcggcaactgcgacgtggtgatcggcatcgtcaacaacacggtgtacgaccccctgcagcccgagctggactccttcaaggaggagctcgacaagtacttcaagaaccacaccagccccgacgtggacctgggggacatctccggcatcaacgccagcgtcgtgaacatccagaaggagatcgaccgcctgaacgaggtggccaagaacctcaacgagtccctgatcgacctgcaggagctcgggaagtacgagcagtacatcaagtggccgtggtacatctggctgggcttcatcgccggcctgatcgcgatcgtcatggtgaccatcatgctctgctgcatgaccagctgctgctcctgcctgaaggggtgctgcagctgcggctcctgctgcaagttcgacgaggacgacagcgagcccgtgctgaagggggtcaagctccactacacgtga

SEQ ID NO: 11738 - RNA, 3822 nt, synthetic construct
  misc_feature 1..3822: note = SARS-CoV-2/Australia/VIC01/2020__EPI_ISL_406844 spike protein CDS gc (1-1273)
  source 1..3822: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggcgctacctcacgccgggggactccagcagcggctggaccgcgggcgccgccgcctactacgtggggtacctgcagccccggaccttcctgctcaagtacaacgagaacggcaccatcacggacgcggtcgactgcgccctggaccccctgtccgagaccaagtgcaccctcaagagcttcaccgtggagaaggggatctaccagacgtccaacttccgcgtgcagcccaccgagagcatcgtccggttcccgaacatcaccaacctgtgccccttcggcgaggtgttcaacgccacccgcttcgcctccgtctacgcctggaaccggaagcgcatcagcaactgcgtggcggactactccgtgctgtacaacagcgcctccttcagcacgttcaagtgctacggcgtctcccccaccaagctcaacgacctgtgcttcaccaacgtgtacgccgacagcttcgtgatccgcggggacgaggtccggcagatcgcccccggccagaccgggaagatcgccgactacaactacaagctgccggacgacttcacgggctgcgtgatcgcgtggaactccaacaacctcgacagcaaggtcgggggcaactacaactacctgtaccggctgttccgcaagtccaacctcaagcccttcgagcgggacatcagcaccgagatctaccaggccggctccaccccctgcaacggggtggagggcttcaactgctacttccccctgcagagctacgggttccagccgaccaacggcgtggggtaccagccctaccgcgtggtcgtgctgtccttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgggacccccagaccctggagatcctcgacatcaccccctgcagcttcggcggggtgagcgtgatcacgccgggcaccaacacctccaaccaggtcgccgtgctgtaccaggacgtgaactgcaccgaggtccccgtggccatccacgccgaccagctgacgcccacctggcgcgtgtacagcaccggctccaacgtcttccagacccgggccgggtgcctcatcggcgcggagcacgtgaacaacagctacgagtgcgacatccccatcggggccggcatctgcgcctcctaccagacgcagaccaacagcccgcgccgggcccgctccgtggcgagccagtccatcatcgcctacaccatgagcctgggcgccgagaactccgtcgcctacagcaacaactccatcgccatccccaccaacttcacgatcagcgtgaccaccgagatcctgcccgtgtccatgaccaagacgagcgtcgactgcaccatgtacatctgcggggacagcaccgagtgctccaacctcctgctgcagtacggcagcttctgcacccagctcaaccgggcgctgacggggatcgccgtggagcaggacaagaacacccaggaggtgttcgcccaggtcaagcagatctacaagacgcccccgatcaaggacttcggcgggttcaacttctcccagatcctgcccgaccccagcaagccctccaagcgcagcttcatcgaggacctcctgttcaacaaggtgaccctggccgacgccggcttcatcaagcagtacggcgactgcctcggggacatcgcggcccgggacctgatctgcgcccagaagttcaacggcctgaccgtgctcccgcccctgctgaccgacgagatgatcgcccagtacacctccgccctcctggcggggaccatcacgagcggctggaccttcggggccggcgccgccctgcagatccccttcgcgatgcagatggcctaccgcttcaacggcatcggggtcacccagaacgtgctctacgagaaccagaagctgatcgccaaccagttcaactccgccatcggcaagatccaggacagcctgtccagcaccgcctccgcgctcgggaagctgcaggacgtggtcaaccagaacgcccaggccctgaacacgctcgtgaagcagctgagctccaacttcggcgccatcagctccgtgctgaacgacatcctcagccggctggacaaggtcgaggccgaggtgcagatcgaccgcctgatcaccgggcggctccagtccctgcagacctacgtgacccagcagctgatccgcgcggccgagatccgggccagcgccaacctcgccgcgaccaagatgagcgagtgcgtcctgggccagtccaagcgcgtggacttctgcggcaaggggtaccacctgatgagcttcccccagtccgccccgcacggcgtggtcttcctccacgtgacgtacgtccccgcccaggagaagaacttcaccaccgcccccgcgatctgccacgacgggaaggcccacttcccccgggagggcgtgttcgtgagcaacgggacccactggttcgtcacgcagcgcaacttctacgagccgcagatcatcaccaccgacaacaccttcgtgtccggcaactgcgacgtggtcatcggcatcgtgaacaacacggtgtacgaccccctgcagcccgagctggacagcttcaaggaggagctcgacaagtacttcaagaaccacacctcccccgacgtcgacctgggggacatcagcggcatcaacgcctccgtggtgaacatccagaaggagatcgaccggctgaacgaggtcgccaagaacctcaacgagagcctgatcgacctgcaggagctcgggaagtacgagcagtacatcaagtggccgtggtacatctggctgggcttcatcgccggcctgatcgcgatcgtgatggtgaccatcatgctctgctgcatgacctcctgctgcagctgcctgaaggggtgctgctcctgcggcagctgctgcaagttcgacgaggacgactccgagcccgtcctgaagggggtgaagctccactacacgtga

SEQ ID NO: 11739 - RNA, 3822 nt, synthetic construct
  misc_feature 1..3822: note = SARS-CoV-2/Germany/BavPat1/2020__EPI_ISL_406862 spike protein CDS gc (1-1273)
  source 1..3822: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacaaggtcgaggccgaggtgcagatcgaccggctgatcaccggccgcctccagagcctgcagacctacgtgacccagcagctgatccgggcggccgagatccgcgccagcgccaacctcgccgcgaccaagatgtccgagtgcgtcctgggccagagcaagcgggtggacttctgcgggaagggctaccacctgatgtccttcccccagagcgccccgcacggggtggtcttcctccacgtgacgtacgtccccgcccaggagaagaacttcaccaccgcccccgcgatctgccacgacggcaaggcccacttcccccgcgagggggtgttcgtgtccaacggcacccactggttcgtcacgcagcggaacttctacgagccgcagatcatcaccaccgacaacaccttcgtgagcggcaactgcgacgtggtcatcgggatcgtgaacaacacggtgtacgaccccctgcagcccgagctggactccttcaaggaggagctcgacaagtacttcaagaaccacaccagccccgacgtcgacctgggcgacatctccgggatcaacgccagcgtggtgaacatccagaaggagatcgaccgcctgaacgaggtcgccaagaacctcaacgagtccctgatcgacctgcaggagctcggcaagtacgagcagtacatcaagtggccgtggtacatctggctgggcttcatcgccgggctgatcgcgatcgtgatggtgaccatcatgctctgctgcatgaccagctgctgctcctgcctgaagggctgctgcagctgcgggtcctgctgcaagttcgacgaggacgacagcgagcccgtcctgaagggcgtgaagctccactacacgtga

SEQ ID NO: 11740 - RNA, 3822 nt, synthetic construct
  misc_feature 1..3822: note = SARS-CoV-2/Wuhan/HBCDC-HB-02/2020__EPI_ISL_412978 spike protein CDS gc (1-1273)
  source 1..3822: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacttcctcctgcagtacggctccttctgcacccagctgaaccgcgcgctcacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctgggggacatcgcggcccgcgacctcatctgcgcccagaagttcaacggcctgaccgtgctgccgcccctcctgaccgacgagatgatcgcccagtacaccagcgccctgctcgcggggaccatcacgtccggctggaccttcggggccggcgccgccctgcagatccccttcgcgatgcagatggcctaccggttcaacggcatcggggtcacccagaacgtgctgtacgagaaccagaagctcatcgccaaccagttcaacagcgccatcggcaagatccaggactccctgagctccaccgccagcgcgctggggaagctccaggacgtggtcaaccagaacgcccaggccctgaacacgctggtgaagcagctctccagcaacttcggcgccatctccagcgtgctgaacgacatcctgtcccgcctcgacaaggtcgaggccgaggtgcagatcgaccggctgatcaccgggcgcctgcagagcctccagacctacgtgacccagcagctgatccgggcggccgagatccgcgccagcgccaacctggccgcgaccaagatgtccgagtgcgtcctcggccagagcaagcgggtggacttctgcggcaaggggtaccacctgatgtccttcccccagagcgccccgcacggcgtggtcttcctgcacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctccagcccgagctggactccttcaaggaggagctggacaagtacttcaagaaccacaccagccccgacgtcgacctcggggacatctccggcatcaacgccagcgtggtgaacatccagaaggagatcgaccgcctgaacgaggtcgccaagaacctgaacgagtccctcatcgacctgcaggagctggggaagtacgagcagtacatcaagtggccgtggtacatctggctcggcttcatcgccggcctgatcgcgatcgtgatggtgaccatcatgctgtgctgcatgaccagctgctgctcctgcctcaaggggtgctgcagctgcggctcctgctgcaagttcgacgaggacgacagcgagcccgtcctgaagggggtgaagctgcactacacgtga

SEQ ID NO: 11741 - RNA, 3822 nt, synthetic construct
  misc_feature 1..3822: note = SARS-CoV-2/Australia/QLD02/2020__EPI_ISL_407896 spike protein CDS gc (1-1273)
  source 1..3822: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagctggagctcgactccttcaaggaggagctggacaagtacttcaagaaccacaccagccccgacgtcgacctgggggacatctccggcatcaacgccagcgtggtgaacatccagaaggagatcgaccgcctcaacgaggtcgccaagaacctgaacgagtccctgatcgacctccaggagctggggaagtacgagcagtacatcaagtggccctggtacatctggctgggcttcatcgccggcctcatcgcgatcgtgatggtgaccatcatgctgtgctgcatgaccagctgctgctcctgcctgaaggggtgctgcagctgcggctcctgctgcaagttcgacgaggacgacagcgagccggtcctcaagggggtgaagctgcactacacgtga

SEQ ID NO: 11742 - RNA, 3822 nt, synthetic construct
  misc_feature 1..3822: note = SARS-CoV-2/India/1-31/2020__EPI_ISL_413523 spike protein CDS gc (1-1273)
  source 1..3822: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgtgatcggcaagatccaggactccctgagctccaccgccagcgccctcgggaagctgcaggacgtcgtgaaccagaacgcgcaggccctgaacacgctcgtgaagcagctgtccagcaacttcggcgccatctccagcgtcctgaacgacatcctctcccgcctggacaaggtggaggccgaggtgcagatcgaccggctgatcaccgggcgcctccagagcctgcagacctacgtcacccagcagctgatccgggccgcggagatccgcgccagcgccaacctcgccgccaccaagatgtccgagtgcgtgctgggccagagcaagcgggtggacttctgcggcaaggggtaccacctgatgtccttcccccagagcgcgccgcacggcgtcgtgttcctccacgtcacgtacgtgcccgcccaggagaagaacttcaccaccgcccccgccatctgccacgacgggaaggcgcacttcccccgcgagggcgtgttcgtctccaacgggacccactggttcgtgacgcagcggaacttctacgagccgcagatcatcaccaccgacaacaccttcgtgagcggcaactgcgacgtcgtgatcggcatcgtgaacaacacggtctacgaccccctgcagcccgagctggactccttcaaggaggagctcgacaagtacttcaagaaccacaccagccccgacgtggacctgggggacatctccggcatcaacgccagcgtggtcaacatccagaaggagatcgaccgcctgaacgaggtggccaagaacctcaacgagtccctgatcgacctgcaggagctcgggaagtacgagcagtacatcaagtggccgtggtacatctggctgggcttcatcgccggcctgatcgccatcgtgatggtcaccatcatgctctgctgcatgaccagctgctgctcctgcctgaaggggtgctgcagctgcggctcctgctgcaagttcgacgaggacgacagcgagcccgtgctgaagggggtgaagctccactacacgtga

SEQ ID NO: 11743 - RNA, 3822 nt, synthetic construct
  misc_feature 1..3822: note SARS-CoV-2/Guangdong/GD2020087-P0008/2020__EPI_ISL_413863 spike protein CDS gc (1-1273)
  source 1..3822: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccgggagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtga

SEQ ID NO: 11744 - RNA, 3822 nt, synthetic construct
  misc_feature 1..3822: note = SARS-CoV-2/Sweden/01/2020__EPI_ISL_411951 spike protein CDS gc (1-1273)
  source 1..3822: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggactgcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtga

SEQ ID NO: 11745 - RNA, 3822 nt, synthetic construct
  misc_feature 1..3822: note = SARS-CoV-2/Tianmen/HBCDC-HB-07/2020__EPI_ISL_412983 spike protein CDS gc (1-1273)
  source 1..3822: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacctgaactgcaccgaggtgcccgtcgccatccacgccgaccagctcacgcccacctggcgggtgtactccaccggcagcaacgtgttccagacccgcgccgggtgcctgatcggcgcggagcacgtcaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtggcctactccaacaacagcatcgccatccccaccaacttcacgatctccgtcaccaccgagatcctccccgtgagcatgaccaagacgagcgtggactgcaccatgtacatctgcggggactccaccgagtgcagcaacctgctgctccagtacggctccttctgcacccagctgaaccgcgcgctgacggggatcgccgtcgagcaggacaagaacacccaggaggtgttcgcccaggtgaagcagatctacaagacgcccccgatcaaggacttcggcgggttcaacttcagccagatcctccccgacccctccaagcccagcaagcggtccttcatcgaggacctgctgttcaacaaggtcaccctcgccgacgccggcttcatcaagcagtacggcgactgcctgggggacatcgcggcccgcgacctgatctgcgcccagaagttcaacggcctcaccgtgctgccgcccctgctcaccgacgagatgatcgcccagtacaccagcgccctgctggcggggaccatcacgtccggctggaccttcggggccggcgccgccctccagatccccttcgcgatgcagatggcctaccggttcaacggcatcggggtgacccagaacgtcctgtacgagaaccagaagctgatcgccaaccagttcaacagcgccatcggcaagatccaggactccctcagctccaccgccagcgcgctggggaagctgcaggacgtggtgaaccagaacgcccaggccctcaacacgctggtcaagcagctgtccagcaacttcggcgccatctccagcgtgctcaacgacatcctgtcccgcctggacaaggtggaggccgaggtccagatcgaccggctcatcaccgggcgcctgcagagcctgcagacctacgtgacccagcagctcatccgggcggccgagatccgcgccagcgccaacctggccgcgaccaagatgtccgagtgcgtgctgggccagagcaagcgggtcgacttctgcggcaaggggtaccacctcatgtccttcccccagagcgccccgcacggcgtggtgttcctgcacgtcacgtacgtgcccgcccaggagaagaacttcaccaccgcccccgcgatctgccacgacgggaaggcccacttcccccgcgagggcgtcttcgtgtccaacgggacccactggttcgtgacgcagcggaacttctacgagccgcagatcatcaccaccgacaacaccttcgtcagcggcaactgcgacgtggtgatcggcatcgtcaacaacacggtgtacgaccccctgcagcccgagctcgactccttcaaggaggagctggacaagtacttcaagaaccacaccagccccgacgtggacctgggggacatctccggcatcaacgccagcgtcgtgaacatccagaaggagatcgaccgcctcaacgaggtggccaagaacctgaacgagtccctgatcgacctccaggagctggggaagtacgagcagtacatcaagtggccgtggtacatctggctgggcttcatcgccggcctcatcgcgatcgtcatggtgaccatcatgctgtgctgcatgaccagctgctgctcctgcctgaaggggtgctgcagctgcggctcctgctgcaagttcgacgaggacgacagcgagcccgtgctcaagggggtcaagctgcactacacgtga

SEQ ID NO: 11746 - RNA, 3822 nt, synthetic construct
  misc_feature 1..3822: note = SARS-CoV-2/Hong Kong/case42_VM20002493/2020__EPI_ISL_414527 spike protein CDS gc (1-1273)
  source 1..3822: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcgcgatctccgtgacgaccgagatcctgcccgtgagcatgaccaagaccagcgtcgactgcacgatgtacatctgcggggactccaccgagtgcagcaacctcctgctgcagtacggctccttctgcacccagctcaaccgcgccctgaccgggatcgccgtggagcaggacaagaacacgcaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgcgggcttcatcaagcagtacggcgactgcctcggggacatcgccgcccgcgacctgatctgcgcccagaagttcaacggcctgaccgtgctcccgcccctgctgaccgacgagatgatcgcccagtacaccagcgcgctcctggccgggaccatcacctccggctggacgttcggggccggcgccgcgctgcagatccccttcgccatgcagatggcctaccggttcaacggcatcggggtcacccagaacgtgctctacgagaaccagaagctgatcgccaaccagttcaacagcgccatcggcaagatccaggactccctgagctccaccgcgagcgccctcgggaagctgcaggacgtggtcaaccagaacgcccaggccctgaacaccctcgtgaagcagctgtccagcaacttcggcgccatctccagcgtgctgaacgacatcctctcccgcctggacaaggtcgaggcggaggtgcagatcgaccggctgatcacggggcgcctccagagcctgcagacctacgtgacccagcagctgatccgggccgccgagatccgcgccagcgccaacctcgcggccaccaagatgtccgagtgcgtcctgggccagagcaagcgggtggacttctgcggcaaggggtaccacctgatgtccttcccccagagcgccccgcacggcgtggtcttcctccacgtgacctacgtccccgcccaggagaagaacttcacgaccgcgcccgccatctgccacgacgggaaggcccacttcccccgcgagggcgtgttcgtgtccaacgggacccactggttcgtcacccagcggaacttctacgagccgcagatcatcacgaccgacaacaccttcgtgagcggcaactgcgacgtggtcatcggcatcgtgaacaacaccgtgtacgaccccctgcagcccgagctggactccttcaaggaggagctcgacaagtacttcaagaaccacacgagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgcgggcctgatcgccatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacctga

SEQ ID NO: 11747 - RNA, 3822 nt, synthetic construct
  misc_feature 1..3822: note = SARS-CoV-2/USA/CruiseA-23/2020__EPI_ISL_414482 spike protein CDS gc (1-1273)
  source 1..3822: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggaggtgaagcagggcaacttcaagaacctccgcgagttcgtcttcaagaacatcgacgggtacttcaagatctactccaagcacaccccgatcaacctggtgcgggacctgccccagggcttcagcgccctcgagcccctggtggacctgcccatcgggatcaacatcacccgcttccagaccctcctggccctgcaccggtcctacctcacgccgggcgacagcagctccgggtggaccgcgggcgccgccgcctactacgtcggctacctgcagccccgcaccttcctgctcaagtacaacgagaacgggaccatcacggacgcggtggactgcgccctggaccccctgagcgagaccaagtgcaccctcaagtccttcaccgtggagaagggcatctaccagacgagcaacttccgggtccagcccaccgagtccatcgtgcgcttcccgaacatcaccaacctgtgccccttcggggaggtcttcaacgccacccggttcgccagcgtgtacgcctggaaccgcaagcggatctccaactgcgtggcggactacagcgtcctgtacaactccgccagcttctccacgttcaagtgctacggcgtgagccccaccaagctcaacgacctgtgcttcaccaacgtgtacgccgactccttcgtcatccgcggcgacgaggtgcggcagatcgcccccgggcagaccggcaagatcgccgactacaactacaagctgccggacgacttcacggggtgcgtgatcgcgtggaacagcaacaacctcgactccaaggtcggcgggaactacaactacctgtaccgcctgttccgcaagagcaacctcaagcccttcgagcgggacatctccaccgagatctaccaggccggcagcaccccctgcaacggcgtggaggggttcaactgctacttccccctgcagtcctacggcttccagccgaccaacggggtgggctaccagccctaccgggtcgtggtgctgagcttcgagctcctgcacgcccccgccacggtctgcgggcccaagaagtccaccaacctggtgaagaacaagtgcgtgaacttcaacttcaacggcctcaccggcaccggggtcctgaccgagagcaacaagaagttcctgccgttccagcagttcggccgcgacatcgccgacacgaccgacgcggtgcgcgacccccagaccctggagatcctcgacatcaccccctgcagcttcgggggcgtgtccgtcatcacgccggggaccaacaccagcaaccaggtggccgtgctgtaccaggacgtcaactgcaccgaggtgcccgtggccatccacgccgaccagctgacgcccacctggcgggtctactccaccggcagcaacgtgttccagacccgcgccggctgcctcatcggggcggagcacgtgaacaactcctacgagtgcgacatccccatcggcgccgggatctgcgccagctaccagacgcagaccaactccccgcggcgcgcccggagcgtcgcgtcccagagcatcatcgcctacaccatgtccctgggcgccgagaacagcgtggcctactccaacaacagcatcgccatccccaccaacttcacgatctccgtgaccaccgagatcctgcccgtcagcatgaccaagacgagcgtggactgcaccatgtacatctgcggcgactccaccgagtgcagcaacctcctgctgcagtacgggtccttctgcacccagctcaaccgcgcgctgacgggcatcgccgtggagcaggacaagaacacccaggaggtcttcgcccaggtgaagcagatctacaagacgcccccgatcaaggacttcgggggcttcaacttcagccagatcctgcccgacccctccaagcccagcaagcggtccttcatcgaggacctcctgttcaacaaggtgaccctggccgacgccgggttcatcaagcagtacggcgactgcctcggcgacatcgcggcccgcgacctgatctgcgcccagaagttcaacgggctgaccgtcctcccgcccctgctgaccgacgagatgatcgcccagtacaccagcgccctcctggcgggcaccatcacgtccgggtggaccttcggcgccggggccgccctgcagatccccttcgcgatgcagatggcctaccggttcaacggcatcggcgtgacccagaacgtgctctacgagaaccagaagctgatcgccaaccagttcaacagcgccatcgggaagatccaggactccctgagctccaccgccagcgcgctcggcaagctgcaggacgtcgtgaaccagaacgcccaggccctgaacacgctcgtgaagcagctgtccagcaacttcggggccatctccagcgtcctgaacgacatcctctcccgcctggacaaggtggaggccgaggtgcagatcgaccggctgatcaccggccgcctccagagcctgcagacctacgtcacccagcagctgatccgggcggccgagatccgcgccagcgccaacctcgccgcgaccaagatgtccgagtgcgtgctggggcagagcaagcgggtggacttctgcggcaagggctaccacctgatgtccttcccccagagcgccccgcacggggtcgtgttcctccacgtcacgtacgtgcccgcccaggagaagaacttcaccaccgcccccgcgatctgccacgacggcaaggcccacttcccccgcgagggggtgttcgtctccaacggcacccactggttcgtgacgcagcggaacttctacgagccgcagatcatcaccaccgacaacaccttcgtgagcgggaactgcgacgtcgtgatcggcatcgtgaacaacacggtctacgaccccctgcagcccgagctggactccttcaaggaggagctcgacaagtacttcaagaaccacaccagccccgacgtggacctgggcgacatctccgggatcaacgccagcgtggtcaacatccagaaggagatcgaccgcctgaacgaggtggccaagaacctcaacgagtccctgatcgacctgcaggagctcggcaagtacgagcagtacatcaagtggccgtggtacatctggctggggttcatcgccggcctgatcgcgatcgtgatggtcaccatcatgctctgctgcatgaccagctgctgctcctgcctgaagggctgctgcagctgcgggtcctgctgcaagttcgacgaggacgacagcgagcccgtgctgaagggcgtgaagctccactacacgtga

SEQ ID NO: 11748 - RNA, 3822 nt, synthetic construct
  misc_feature 1..3822: note = SARS-CoV-2/Hong Kong/case85_VM20002868/2020__EPI_ISL_414519 spike protein CDS gc (1-1273)
  source 1..3822: mol_type = other RNA
atgttcgtgttcctggtcctcgtgcccctggtgagctcccagtgcgtcaacctgaccacccgcacgcagctcccgcccgcctacaccaacagcttcacccggggcgtgtactaccccgacaaggtgttccgctccagcgtcctgcactccacccaggacctgttcctccccttcttcagcaacgtgacgtggttccacgccatccacgtgtccgggaccaacggcaccaagcggttcgacaacccggtcctgcccttcaacgacggggtgtacttcgcgagcaccgagaagtccaacatcatccgcggctggatcttcgggacgaccctggacagcaagacccagtccctcctgatcgtgaacaacgccaccaacgtcgtgatcaaggtgtgcgagttccagttctgcaacgaccccttcctgggcgtctactaccacaagaacaacaagagctggatggagtccgagttccgggtgtacagctccgccaacaactgcacgttcgagtacgtgagccagcccttcctcatggacctggagggcaagcaggggaacttcaagaacctgcgcgagttcgtcttcaagaacatcgacggctacttcaagatctactccaagcacaccccgatcaacctcgtgcgggacctgccccaggggttcagcgccctggagcccctcgtggacctgcccatcggcatcaacatcacccgcttccagaccctgctcgccctgcaccggtcctacctgacgccgggggacagcagctccggctggaccgcgggcgccgccgcctactacgtcgggtacctccagccccgcaccttcctgctgaagtacaacgagaacggcaccatcacggacgcggtggactgcgccctcgaccccctgagcgagaccaagtgcaccctgaagtccttcaccgtggagaaggggatctaccagacgagcaacttccgggtccagcccaccgagtccatcgtgcgcttcccgaacatcaccaacctctgccccttcggcgaggtcttcaacgccacccggttcgccagcgtgtacgcctggaaccgcaagcggatctccaactgcgtggcggactacagcgtcctgtacaactccgccagcttctccacgttcaagtgctacggcgtgagccccaccaagctgaacgacctctgcttcaccaacgtgtacgccgactccttcgtcatccgcggggacgaggtgcggcagatcgcccccggccagaccgggaagatcgccgactacaactacaagctgccggacgacttcacgggctgcgtgatcgcgtggaacagcaacaacctggactccaaggtcgggggcaactacaactacctctaccgcctgttccgcaagagcaacctgaagcccttcgagcgggacatctccaccgagatctaccaggccggcagcaccccctgcaacggggtggagggcttcaactgctacttccccctccagtcctacgggttccagccgaccaacggcgtggggtaccagccctaccgggtcgtggtgctgagcttcgagctgctccacgcccccgccacggtctgcggccccaagaagtccaccaacctggtgaagaacaagtgcgtgaacttcaacttcaacggcctgaccgggaccggcgtcctcaccgagagcaacaagaagttcctgccgttccagcagttcgggcgcgacatcgccgacacgaccgacgcggtgcgcgacccccagaccctggagatcctggacatcaccccctgcagcttcggcggggtgtccgtcatcacgccgggcaccaacaccagcaaccaggtggccgtgctctaccaggacgtcaactgcaccgaggtgcccgtggccatccacgccgaccagctgacgcccacctggcgggtctactccaccggcagcaacgtgttccagacccgcgccgggtgcctgatcggcgcggagcacgtgaacaactcctacgagtgcgacatccccatcggggccggcatctgcgccagctaccagacgcagaccaactccccgcggcgcgcccggagcgtcgcgtcccagagcatcatcgcctacaccatgtccctcggcgccgagaacagcgtggcctactccaacaacagcatcgccatccccaccaacttcacgatctccgtgaccaccgagatcctgcccgtcagcatgaccaagacgagcgtggactgcaccatgtacatctgcggggactccaccgagtgcagcaacctgctcctgcagtacggctccttctgcacccagctgaaccgcgcgctcacggggatcgccgtggagcaggacaagaacacccaggaggtcttcgcccaggtgaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctgggggacatcgcggcccgcgacctcatctgcgcccagaagttcaacggcctgaccgtcctgccgcccctcctgaccgacgagatgatcgcccagtacaccagcgccctgctcgcggggaccatcacgtccggctggaccttcggggccggcgccgccctgcagatccccttcgcgatgcagatggcctaccggttcaacggcatcggggtgacccagaacgtgctgtacgagaaccagaagctcatcgccaaccagttcaacagcgccatcggcaagatccaggactccctgagctccaccgccagcgcgctggggaagctccaggacgtcgtgaaccagaacgcccaggccctgaacacgctggtgaagcagctctccagcaacttcggcgccatctccagcgtcctgaacgacatcctgtcccgcctcgacaaggtggaggccgaggtgcagatcgaccggctgatcaccgggcgcctgcagagcctccagacctacgtcacccagcagctgatccgggcggccgagatccgcgccagcgccaacctggccgcgaccaagatgtccgagtgcgtgctcggccagagcaagcgggtggacttctgcggcaaggggtaccacctgatgtccttcccccagagcgccccgcacggcgtcgtgttcctgcacgtcacgtacgtgcccgcccaggagaagaacttcaccaccgcccccgcgatctgccacgacgggaaggcccacttcccccgcgagggcgtgttcgtctccaacgggacccactggttcgtgacgcagcggaacttctacgagccgcagatcatcaccaccgacaacaccttcgtgagcggcaactgcgacgtcgtgatcggcatcgtgaacaacacggtctacgaccccctccagcccgagctggactccttcaaggaggagctggacaagtacttcaagaaccacaccagccccgacgtggacctcggggacatctccggcatcaacgccagcgtggtcaacatccagaaggagatcgaccgcctgaacgaggtggccaagaacctgaacgagtccctcatcgacctgcaggagctggggaagtacgagcagtacatcaagtggccgtggtacatctggctcggcttcatcgccggcctgatcgcgatcgtgatggtcaccatcatgctgtgctgcatgaccagctgctgctcctgcctcaaggggtgctgcagctgcggctcctgctgcaagttcgacgaggacgacagcgagcccgtgctgaagggggtgaagctgcactacacgtga

SEQ ID NO: 11749 - RNA, 3822 nt, synthetic construct
  misc_feature 1..3822: note = SARS-CoV-2/England/200990660/2020__EPI_ISL_414523 spike protein CDS gc (1-1273)
  source 1..3822: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacaaggtcgaggccgaggtgcagatcgaccggctgatcaccggccgcctccagagcctgcagacctacgtgacccagcagctgatccgggcggccgagatccgcgccagcgccaacctcgccgcgaccaagatgtccgagtgcgtcctgggccagagcaagcgggtggacttctgcgggaagggctaccacctgatgtccttcccccagagcgccccgcacggggtggtcttcctccacgtgacgtacgtccccgcccaggagaagaacttcaccaccgcccccgcgatctgccacgacggcaaggcccacttcccccgcgagggggtgttcgtgtccaacggcacccactggttcgtcacgcagcggaacttctacgagccgcagatcatcaccaccgacaacaccttcgtgagcggcaactgcgacgtggtcatcgggatcgtgaacaacacggtgtacgaccccctgcagcccgagctggactccttcaaggaggagctcgacaagtacttcaagaaccacaccagccccgacgtcgacctgggcgacatctccgggatcaacgccagcgtggtgaacatccagaaggagatcgaccgcctgaacgaggtcgccaagaacctcaacgagtccctgatcgacctgcaggagctcggcaagtacgagcagtacatcaagtggccgtggtacatctggctgggcttcatcgccgggctgatcgcgatcgtgatggtgaccatcatgctctgctgcatgaccagctgctgctcctgcctgaagggctgctgcagctgcgggtcctgctgcaagttcgacgaggacgacagcgagctggtcctcaagggcgtgaagctgcactacacgtga

SEQ ID NO: 11750 - RNA, 3822 nt, synthetic construct
  misc_feature 1..3822: note = SARS-CoV-2/Australia/NSW09/2020__EPI_ISL_413595 spike protein CDS gc (1-1273)
  source 1..3822: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagcttcaccgcctccgcgctcgggaagctgcaggacgtggtcaaccagaacgcccaggccctgaacacgctcgtgaagcagctgagctccaacttcggcgccatcagctccgtgctgaacgacatcctcagccgcctggacaaggtcgaggccgaggtgcagatcgaccggctgatcaccgggcgcctccagtccctgcagacctacgtgacccagcagctgatccgggcggccgagatccgcgccagcgccaacctcgccgcgaccaagatgagcgagtgcgtcctgggccagtccaagcgggtggacttctgcggcaaggggtaccacctgatgagcttcccccagtccgccccgcacggcgtggtcttcctccacgtgacgtacgtccccgcccaggagaagaacttcaccaccgcccccgcgatctgccacgacgggaaggcccacttcccccgcgagggcgtgttcgtgagcaacgggacccactggttcgtcacgcagcggaacttctacgagccgcagatcatcaccaccgacaacaccttcgtgtccggcaactgcgacgtggtcatcggcatcgtgaacaacacggtgtacgaccccctgcagcccgagctggacagcttcaaggaggagctcgacaagtacttcaagaaccacacctcccccgacgtcgacctgggggacatcagcggcatcaacgcctccgtggtgaacatccagaaggagatcgaccgcctgaacgaggtcgccaagaacctcaacgagagcctgatcgacctgcaggagctcgggaagtacgagcagtacatcaagtggccgtggtacatctggctgggcttcatcgccggcctgatcgcgatcgtgatggtgaccatcatgctctgctgcatgacctcctgctgcagctgcctgaaggggtgctgctcctgcggcagctgctgcaagttcgacgaggacgactccgagcccgtcctgaagggggtgaagctccactacacgtga

SEQ ID NO: 11751 - RNA, 3822 nt, synthetic construct
  misc_feature 1..3822: note = SARS-CoV-2/Australia/NSW10/2020__EPI_ISL_413596 spike protein CDS gc (1-1273)
  source 1..3822: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgcttcaagttcgacgaggacgacagcgagcccgtcctgaagggggtgaagctccactacacgtga

SEQ ID NO: 11752 - RNA, 3822 nt, synthetic construct
  misc_feature 1..3822: note SARS-CoV-2/Switzerland/1000477797/2020__EPI_ISL_413023 spike protein CDS gc (1-1273)
  source 1..3822: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaacatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacaaggtcgaggccgaggtgcagatcgaccggctgatcaccggccgcctccagagcctgcagacctacgtgacccagcagctgatccgggcggccgagatccgcgccagcgccaacctcgccgcgaccaagatgtccgagtgcgtcctgggccagagcaagcgggtggacttctgcgggaagggctaccacctgatgtccttcccccagagcgccccgcacggggtggtcttcctccacgtgacgtacgtccccgcccaggagaagaacttcaccaccgcccccgcgatctgccacgacggcaaggcccacttcccccgcgagggggtgttcgtgtccaacggcacccactggttcgtcacgcagcggaacttctacgagccgcagatcatcaccaccgacaacaccttcgtgagcggcaactgcgacgtggtcatcgggatcgtgaacaacacggtgtacgaccccctgcagcccgagctggactccttcaaggaggagctcgacaagtacttcaagaaccacaccagccccgacgtcgacctgggcgacatctccgggatcaacgccagcgtggtgaacatccagaaggagatcgaccgcctgaacgaggtcgccaagaacctcaacgagtccctgatcgacctgcaggagctcggcaagtacgagcagtacatcaagtggccgtggtacatctggctgggcttcatcgccgggctgatcgcgatcgtgatggtgaccatcatgctctgctgcatgaccagctgctgctcctgcctgaagggctgctgcagctgcgggtcctgctgcaagttcgacgaggacgacagcgagcccgtcctgaagggcgtgaagctccactacacgtga

SEQ ID NO: 11753 - RNA, 3822 nt, synthetic construct
  misc_feature 1..3822: note = SARS-CoV-2/Belgium/BA-02291/2020__EPI_ISL_415159 spike protein CDS gc (1-1273)
  source 1..3822: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccggcgcagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgcgtggtcgtgctgagcttcgagctcctgcccgcccccgccacggtgtgcggcccgaagaagtccaccaacctggtcaagaacaagtgcgtgaacttcaacttcaacggcctcaccgggaccggcgtgctgaccgagtccaacaagaagttcctgcccttccagcagttcgggcgcgacatcgccgacacgaccgacgcggtccgggacccccagaccctggagatcctcgacatcaccccgtgcagcttcggcggggtgtccgtgatcacgcccggcaccaacaccagcaaccaggtcgccgtgctgtaccagggcgtgaactgcaccgaggtccccgtggccatccacgccgaccagctgacgcccacctggcgcgtgtactccaccgggagcaacgtcttccagacccgggccggctgcctcatcggggcggagcacgtgaacaactcctacgagtgcgacatcccgatcggcgccggcatctgcgccagctaccagacgcagaccaacagcccccgccgggcccgcagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgggcgctgacgggcatcgccgtggagcaggacaagaacacccaggaggtgttcgcccaggtcaagcagatctacaagaccccgcccatcaaggacttcgggggcttcaacttcagccagatcctgcccgacccctccaagccgagcaagcgctccttcatcgaggacctcctgttcaacaaggtgaccctggccgacgccggcttcatcaagcagtacggggactgcctcggcgacatcgcggcccgggacctgatctgcgcccagaagttcaacgggctgacggtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccgcttcaacgggatcggcgtcacccagaacgtgctctacgagaaccagaagctgatcgccaaccagttcaacagcgccatcgggaagatccaggactccctgagctccgccgcgcccgccctcggcaagctgcaggacgtggtcaaccagaacgcccaggccctgaacaccctcgtgaagcagctgagctccaacttcggggccatcagctccgtgctgaacgacatcctcagccggctggacaaggtcgaggcggaggtgcagatcgaccgcctgatcacgggccggctccagtccctgcagacctacgtgacccagcagctgatccgcgccgccgagatccgggccagcgccaacctcgcggccaccaagatgagcgagtgcgtcctgggccagtccaagcgcgtggacttctgcgggaagggctaccacctgatgagcttcccccagtccgcgccccacggggtggtcttcctccacgtgacctacgtccccgcccaggagaagaacttcacgaccgccccggccatctgccacgacggcaaggcccacttcccccgggagggggtgttcgtgagcaacggcacccactggttcgtcacccagcgcaacttctacgagccccagatcatcacgaccgacaacaccttcgtgtccggcaactgcgacgtggtcatcgggatcgtgaacaacaccgtgtacgaccccctgcagccggagctggacagcttcaaggaggagctcgacaagtacttcaagaaccacacgtcccccgacgtcgacctgggcgacatcagcgggatcaacgcctccgtggtgaacatccagaaggagatcgaccggctgaacgaggtcgccaagaacctcaacgagagcctgatcgacctgcaggagctcggcaagtacgagcagtacatcaagtggccctggtacatctggctgggcttcatcgcggggctgatcgccatcgtgatggtgaccatcatgctctgctgcatgacctcctgctgcagctgcctgaagggctgctgctcctgcgggagctgctgcaagttcgacgaggacgactccgagccggtcctgaagggcgtgaagctccactacacctga

SEQ ID NO: 11754 - RNA, 3822 nt, synthetic construct
  misc_feature 1..3822: note = SARS-CoV-2/USA/WA8-UW5/2020__EPI_ISL_413486 spike protein CDS gc (1-1273)
  source 1..3822: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagtacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtga

SEQ ID NO: 11755 - RNA, 3822 nt, synthetic construct
  misc_feature 1..3822: note = SARS-CoV-2/England/20102000506/2020__EPI_ISL_415147 spike protein CDS gc (1-1273)
  source 1..3822: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacgggtactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacaaggtcgaggccgaggtgcagatcgaccggctgatcaccggccgcctccagagcctgcagacctacgtgacccagcagctgatccgggcggccgagatccgcgccagcgccaacctcgccgcgaccaagatgtccgagtgcgtcctgggccagagcaagcgggtggacttctgcgggaagggctaccacctgatgtccttcccccagagcgccccgcacggggtggtcttcctccacgtgacgtacgtccccgcccaggagaagaacttcaccaccgcccccgcgatctgccacgacggcaaggcccacttcccccgcgagggggtgttcgtgtccaacggcacccactggttcgtcacgcagcggaacttctacgagccgcagatcatcaccaccgacaacaccttcgtgagcggcaactgcgacgtggtcatcgggatcgtgaacaacacggtgtacgaccccctgcagcccgagctggactccttcaaggaggagctcgacaagtacttcaagaaccacaccagccccgacgtcgacctgggcgacatctccgggatcaacgccagcgtggtgaacatccagaaggagatcgaccgcctgaacgaggtcgccaagaacctcaacgagtccctgatcgacctgcaggagctcggcaagtacgagcagtacatcaagtggccgtggtacatctggctgggcttcatcgccgggctgatcgcgatcgtgatggtgaccatcatgctctgctgcatgaccagctgctgctcctgcctgaagggctgctgcagctgcgggtcctgctgcaagttcgacgaggacgacagcgagcccgtcctgaagggcgtgaagctccactacacgtga

SEQ ID NO: 11756 - RNA, 3822 nt, synthetic construct
  misc_feature 1..3822: note = SARS-CoV-2/Belgium/VAG-03013/2020__EPI_ISL_415155 spike protein CDS gc (1-1273)
  source 1..3822: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccacggcgctcggcaagctgcaggacgtggtcaaccagaacgcccaggccctgaacaccctcgtgaagcagctgagctccaacttcggggccatcagctccgtgctgaacgacatcctcagccgcctggacaaggtcgaggccgaggtgcagatcgaccggctgatcaccggccgcctccagtccctgcagacctacgtgacccagcagctgatccgggcggccgagatccgcgccagcgccaacctcgccgcgacgaagatgagcgagtgcgtcctgggccagtccaagcgggtggacttctgcgggaagggctaccacctgatgagcttcccccagtccgccccgcacggggtggtcttcctccacgtgacctacgtccccgcccaggagaagaacttcaccaccgcccccgcgatctgccacgacggcaaggcccacttcccccgcgagggggtgttcgtgagcaacggcacgcactggttcgtcacccagcggaacttctacgagccgcagatcatcaccaccgacaacacgttcgtgtccggcaactgcgacgtggtcatcgggatcgtgaacaacaccgtgtacgaccccctgcagcccgagctggacagcttcaaggaggagctcgacaagtacttcaagaaccacacctcccccgacgtcgacctgggcgacatcagcgggatcaacgcctccgtggtgaacatccagaaggagatcgaccgcctgaacgaggtcgccaagaacctcaacgagagcctgatcgacctgcaggagctcggcaagtacgagcagtacatcaagtggccgtggtacatctggctgggcttcatcgccgggctgatcgcgatcgtgatggtgaccatcatgctctgctgcatgacgtcctgctgcagctgcctgaagggctgctgctcctgcgggagctgctgcaagttcgacgaggacgactccgagcccgtcctgaagggcgtgaagctccactacacctga

SEQ ID NO: 11757 - RNA, 3822 nt, synthetic construct
  misc_feature 1..3822: note = SARS-CoV-2/Belgium/BC-03016/2020__EPI_ISL_415157 spike protein CDS gc (1-1273)
  source 1..3822: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgcccccgcgctcggcaagctgcaggacgtggtcaaccagaacgcccaggccctgaacacgctcgtgaagcagctgagctccaacttcggggccatcagctccgtgctgaacgacatcctcagccgcctggacaaggtcgaggccgaggtgcagatcgaccggctgatcaccggccgcctccagtccctgcagacctacgtgacccagcagctgatccgggcggccgagatccgcgccagcgccaacctcgccgcgaccaagatgagcgagtgcgtcctgggccagtccaagcgggtggacttctgcgggaagggctaccacctgatgagcttcccgcagtccgcgccccacggggtggtcttcctccacgtgacgtacgtccccgcccaggagaagaacttcaccaccgcccccgccatctgccacgacggcaaggcccacttcccgcgcgagggggtgttcgtgagcaacggcacccactggttcgtcacgcagcggaacttctacgagccccagatcatcaccaccgacaacaccttcgtgtccggcaactgcgacgtggtcatcgggatcgtgaacaacacggtgtacgaccccctgcagcccgagctggacagcttcaaggaggagctcgacaagtacttcaagaaccacacctccccggacgtcgacctgggcgacatcagcgggatcaacgcctccgtggtgaacatccagaaggagatcgaccgcctgaacgaggtcgccaagaacctcaacgagagcctgatcgacctgcaggagctcggcaagtacgagcagtacatcaagtggccctggtacatctggctgggcttcatcgccgggctgatcgcgatcgtgatggtgaccatcatgctctgctgcatgacctcctgctgcagctgcctgaagggctgctgctcctgcgggagctgctgcaagttcgacgaggacgactccgagcccgtcctgaagggcgtgaagctccactacacgtga

SEQ ID NO: 11758 - RNA, 3822 nt, synthetic construct
  misc_feature 1..3822: note = SARS-CoV-2/Germany/BavPat3/2020__EPI_ISL_414521 spike protein CDS gc (1-1273)
  source 1..3822: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccagcaggtcttcgcccaggtgaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtga

SEQ ID NO: 11759 - RNA, 3822 nt, synthetic construct
  misc_feature 1..3822: note = SARS-CoV-2/France/HF1805/2020__EPI_ISL_414628 spike protein CDS gc (1-1273)
  source 1..3822: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacaaggtcgaggccgaggtgcagatcgaccggctgatcaccggccgcctccagagcctgcagacctacgtgacccagcagctgatccgggcggccgagatccgcgccagcgccaacctcgccgcgaccaagatgtccgagtgcgtcctgggccagagcaagcgggtggacttctgcgggaagggctaccacctgatgtccttcccccagagcgccccgcacggggtggtcttcctccacgtgacgtacgtccccgcccaggagaagaacttcaccaccgcccccgcgatctgccacgacggcaaggcccacttcccccgcgagggggtgttcgtgtccaacggcacccactggttcgtcacgcagcggaacttctacgagccgcagatcatcaccaccgacaacaccttcgtgagcggcaactgcgacgtggtcatcggggtggtgaacaacacggtctacgaccccctgcagcccgagctggactccttcaaggaggagctcgacaagtacttcaagaaccacaccagccccgacgtggacctgggcgacatctccgggatcaacgccagcgtggtcaacatccagaaggagatcgaccgcctgaacgaggtggccaagaacctcaacgagtccctgatcgacctgcaggagctcggcaagtacgagcagtacatcaagtggccgtggtacatctggctgggcttcatcgccgggctgatcgcgatcgtgatggtcaccatcatgctctgctgcatgaccagctgctgctcctgcctgaagggctgctgcagctgcgggtcctgctgcaagttcgacgaggacgacagcgagcccgtgctgaagggcgtgaagctccactacacgtga

SEQ ID NO: 11760 - RNA, 3822 nt, synthetic construct
  misc_feature 1..3822: note SARS-CoV-2/Netherlands/ZuidHolland_9/2020__EPI_ISL_414445 spike protein CDS gc (1-1273)
  source 1..3822: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgtgcagaagttcaacgggctgaccgtcctcccgcccctgctgaccgacgagatgatcgcccagtacaccagcgccctcctggccggcaccatcacgtccgggtggaccttcggcgcgggcgccgccctgcagatccccttcgccatgcagatggcgtaccggttcaacgggatcggcgtgacccagaacgtgctctacgagaaccagaagctgatcgccaaccagttcaacagcgccatcgggaagatccaggactccctgagctccaccgccagcgccctcggcaagctgcaggacgtcgtgaaccagaacgcgcaggccctgaacacgctcgtgaagcagctgtccagcaacttcggggccatctccagcgtcctgaacgacatcctctcccgcctggacaaggtggaggccgaggtgcagatcgaccggctgatcaccggccgcctccagagcctgcagacctacgtcacccagcagctgatccgggccgcggagatccgcgccagcgccaacctcgccgccaccaagatgtccgagtgcgtgctgggccagagcaagcgggtggacttctgcgggaagggctaccacctgatgtccttcccccagagcgcgccgcacggggtcgtgttcctccacgtcacgtacgtgcccgcccaggagaagaacttcaccaccgcccccgccatctgccacgacggcaaggcgcacttcccccgcgagggggtgttcgtctccaacggcacccactggttcgtgacgcagcggaacttctacgagccgcagatcatcaccaccgacaacaccttcgtgagcggcaactgcgacgtcgtgatcgggatcgtgaacaacacggtctacgaccccctgcagcccgagctggactccttcaaggaggagctcgacaagtacttcaagaaccacaccagccccgacgtggacctgggcgacatctccgggatcaacgccagcgtggtcaacatccagaaggagatcgaccgcctgaacgaggtggccaagaacctcaacgagtccctgatcgacctgcaggagctcggcaagtacgagcagtacatcaagtggccgtggtacatctggctgggcttcatcgccgggctgatcgccatcgtgatggtcaccatcatgctctgctgcatgaccagctgctgctcctgcctgaagggctgctgcagctgcgggtcctgctgcaagttcgacgaggacgacagcgagcccgtgctgaagggcgtgaagctccactacacgtga

SEQ ID NO: 11761 - RNA, 3822 nt, synthetic construct
  misc_feature 1..3822: note = SARS-CoV-2/Finland/FIN03032020A/2020__EPI_ISL_413602 spike protein CDS gc (1-1273)
  source 1..3822: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcagctggaactccaacaacctcgacagcaaggtcgggggcaactacaactacctgtaccgcctgttccggaagtccaacctcaagcccttcgagcgcgacatcagcaccgagatctaccaggcgggctccaccccctgcaacggggtggagggcttcaactgctacttccccctgcagagctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgccgtccgcgacccccagaccctggagatcctcgacatcaccccctgctccttcggcggggtgagcgtgatcacgccgggcaccaacacctccaaccaggtcgcggtgctgtaccagggcgtgaactgcaccgaggtccccgtggccatccacgccgaccagctgacgcccacctggcgggtgtacagcaccgggtccaacgtcttccagacccgcgccggctgcctcatcggggccgagcacgtgaacaacagctacgagtgcgacatccccatcggcgcgggcatctgcgcctcctaccagacgcagaccaacagcccgcggcgcgcccggtccgtggccagccagtccatcatcgcgtacaccatgagcctgggggccgagaactccgtcgcctacagcaacaactccatcgccatccccaccaacttcacgatcagcgtgaccaccgagatcctgcccgtgagcatgaccaagacgtccgtcgactgcaccatgtacatctgcggcgacagcaccgagtgctccaacctcctgctgcagtacgggagcttctgcacccagctcaaccgcgccctgacgggcatcgcggtggagcaggacaagaacacccaggaggtgttcgcccaggtcaagcagatctacaagacgcccccgatcaaggacttcgggggcttcaacttctcccagatcctgcccgaccccagcaagccctccaagcggagcttcatcgaggacctcctgttcaacaaggtgaccctggccgacgccggcttcatcaagcagtacggggactgcctcggcgacatcgccgcgcgcgacctgatctgcgcccagaagttcaacgggctgaccgtgctcccgcccctgctgaccgacgagatgatcgcccagtacacctccgccctcctggccggcaccatcacgagcgggtggaccttcggcgcgggcgccgccctgcagatccccttcgccatgcagatggcgtaccggttcaacgggatcggcgtcacccagaacgtgctctacgagaaccagaagctgatcgccaaccagttcaactccgccatcgggaagatccaggacagcctgtccagcaccgcctccgccctcggcaagctgcaggacgtggtcaaccagaacgcgcaggccctgaacacgctcgtgaagcagctgagctccaacttcggggccatcagctccgtgctgaacgacatcctcagccgcctggacaaggtcgaggccgaggtgcagatcgaccggctgatcaccggccgcctccagagcctgcagacctacgtgacccagcagctgatccgggccgcggagatccgcgcctccgccaacctcgccgccaccaagatgagcgagtgcgtcctgggccagtccaagcgggtggacttctgcgggaagggctaccacctgatgagcttcccccagtccgcgccgcacggggtggtcttcctccacgtgacgtacgtccccgcccaggagaagaacttcaccaccgcccccgccatctgccacgacggcaaggcgcacttcccccgcgagggggtgttcgtgagcaacggcacccactggttcgtcacgcagcggaacttctacgagccgcagatcatcaccaccgacaacaccttcgtgtccggcaactgcgacgtggtcatcgggatcgtgaacaacacggtgtacgaccccctgcagcccgagctggacagcttcaaggaggagctcgacaagtacttcaagaaccacacctcccccgacgtcgacctgggcgacatcagcgggatcaacgcctccgtggtgaacatccagaaggagatcgaccgcctgaacgaggtcgccaagaacctcaacgagagcctgatcgacctgcaggagctcggcaagtacgagcagtacatcaagtggccgtggtacatctggctgggcttcatcgccgggctgatcgccatcgtgatggtgaccatcatgctctgctgcatgacctcctgctgcagctgcctgaagggctgctgctcctgcgggagctgctgcaagttcgacgaggacgactccgagcccgtcctgaagggcgtgaagctccactacacgtga

SEQ ID NO: 11762 - RNA, 3822 nt, synthetic construct
  misc_feature 1..3822: note = SARS-CoV-2/France/GE1977/2020__EPI_ISL_414632 spike protein CDS gc (1-1273)
  source 1..3822: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgttcagcaccgcctccgcgctcggcaagctgcaggacgtggtcaaccagaacgcccaggccctgaacacgctcgtgaagcagctgagctccaacttcggggccatcagctccgtgctgaacgacatcctcagccgcctggacaaggtcgaggccgaggtgcagatcgaccggctgatcaccggccgcctccagtccctgcagacctacgtgacccagcagctgatccgggcggccgagatccgcgccagcgccaacctcgccgcgaccaagatgagcgagtgcgtcctgggccagtccaagcgggtggacttctgcgggaagggctaccacctgatgagcttcccccagtccgccccgcacggggtggtcttcctccacgtgacgtacgtccccgcccaggagaagaacttcaccaccgcccccgcgatctgccacgacggcaaggcccacttcccccgcgagggggtgttcgtgagcaacggcacccactggttcgtcacgcagcggaacttctacgagccgcagatcatcaccaccgacaacaccttcgtgtccggcaactgcgacgtggtcatcgggatcgtgaacaacacggtgtacgaccccctgcagcccgagctggacagcttcaaggaggagctcgacaagtacttcaagaaccacacctcccccgacgtcgacctgggcgacatcagcgggatcaacgcctccgtggtgaacatccagaaggagatcgaccgcctgaacgaggtcgccaagaacctcaacgagagcctgatcgacctgcaggagctcggcaagtacgagcagtacatcaagtggccgtggtacatctggctgggcttcatcgccgggctgatcgcgatcgtgatggtgaccatcatgctctgctgcatgacctcctgctgcagctgcctgaagggctgctgctcctgcgggagctgctgcaagttcgacgaggacgactccgagcccgtcctgaagggcgtgaagctccactacacgtga

SEQ ID NO: 11763 - RNA, 3822 nt, synthetic construct
  misc_feature 1..3822: note = SARS-CoV-2/Finland/FIN-313/2020__EPI_ISL_414641 spike protein CDS gc (1-1273)
  source 1..3822: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttcaagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacaaggtcgaggccgaggtgcagatcgaccggctgatcaccggccgcctccagagcctgcagacctacgtgacccagcagctgatccgggcggccgagatccgcgccagcgccaacctcgccgcgaccaagatgtccgagtgcgtcctgggccagagcaagcgggtggacttctgcgggaagggctaccacctgatgtccttcccccagagcgccccgcacggggtggtcttcctccacgtgacgtacgtccccgcccaggagaagaacttcaccaccgcccccgcgatctgccacgacggcaaggcccacttcccccgcgagggggtgttcgtgtccaacggcacccactggttcgtcacgcagcggaacttctacgagccgcagatcatcaccaccgacaacaccttcgtgagcggcaactgcgacgtggtcatcgggatcgtgaacaacacggtgtacgaccccctgcagcccgagctggactccttcaaggaggagctcgacaagtacttcaagaaccacaccagccccgacgtcgacctgggcgacatctccgggatcaacgccagcgtggtgaacatccagaaggagatcgaccgcctgaacgaggtcgccaagaacctcaacgagtccctgatcgacctgcaggagctcggcaagtacgagcagtacatcaagtggccgtggtacatctggctgggcttcatcgccgggctgatcgcgatcgtgatggtgaccatcatgctctgctgcatgaccagctgctgctcctgcctgaagggctgctgcagctgcgggtcctgctgcaagttcgacgaggacgacagcgagcccgtcctgaagggcgtgaagctccactacacgtga

SEQ ID NO: 11764 - RNA, 3822 nt, synthetic construct
  misc_feature 1..3822: note SARS-CoV-2/Netherlands/ZuidHolland_2/2020__EPI_ISL_414556 spike protein CDS gc (1-1273)
  source 1..3822: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccctggagcaggacaagaacacccaggaggtgttcgcccaggtgaagcagatctacaagacgcccccgatcaaggacttcgggggcttcaacttcagccagatcctccccgacccctccaagcccagcaagcggtccttcatcgaggacctgctgttcaacaaggtcaccctcgccgacgccggcttcatcaagcagtacggggactgcctgggcgacatcgcggcccgcgacctgatctgcgcccagaagttcaacgggctcaccgtgctgccgcccctgctcaccgacgagatgatcgcccagtacaccagcgccctgctggcgggcaccatcacgtccgggtggaccttcggcgccggcgccgccctccagatccccttcgcgatgcagatggcctaccggttcaacgggatcggcgtgacccagaacgtcctgtacgagaaccagaagctgatcgccaaccagttcaacagcgccatcgggaagatccaggactccctcagctccaccgccagcgcgctgggcaagctgcaggacgtggtgaaccagaacgcccaggccctcaacacgctggtcaagcagctgtccagcaacttcggggccatctccagcgtgctcaacgacatcctgtcccgcctggacaaggtggaggccgaggtccagatcgaccggctcatcaccggccgcctgcagagcctgcagacctacgtgacccagcagctcatccgggcggccgagatccgcgccagcgccaacctggccgcgaccaagatgtccgagtgcgtgctgggccagagcaagcgggtcgacttctgcgggaagggctaccacctcatgtccttcccccagagcgccccgcacggggtggtgttcctgcacgtcacgtacgtgcccgcccaggagaagaacttcaccaccgcccccgcgatctgccacgacggcaaggcccacttcccccgcgagggggtcttcgtgtccaacggcacccactggttcgtgacgcagcggaacttctacgagccgcagatcatcaccaccgacaacaccttcgtcagcggcaactgcgacgtggtgatcgggatcgtcaacaacacggtgtacgaccccctgcagcccgagctcgactccttcaaggaggagctggacaagtacttcaagaaccacaccagccccgacgtggacctgggcgacatctccgggatcaacgccagcgtcgtgaacatccagaaggagatcgaccgcctcaacgaggtggccaagaacctgaacgagtccctgatcgacctccaggagctgggcaagtacgagcagtacatcaagtggccgtggtacatctggctgggcttcatcgccgggctcatcgcgatcgtcatggtgaccatcatgctgtgctgcatgaccagctgctgctcctgcctgaagggctgctgcagctgcgggtcctgctgcaagttcgacgaggacgacagcgagcccgtgctcaagggcgtcaagctgcactacacgtga

SEQ ID NO: 11765 - RNA, 3822 nt, synthetic construct
  misc_feature 1..3822: note = SARS-CoV-2/USA/WA-UW31/2020__EPI_ISL_414618 spike protein CDS gc (1-1273)
  source 1..3822: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggccgagggcttcaactgctacttccccctgcagtcctacgggttccagccgaccaacggcgtggggtaccagccctaccgggtggtggtcctgagcttcgagctcctgcacgcccccgccacggtgtgcggccccaagaagtccaccaacctggtgaagaacaagtgcgtcaacttcaacttcaacggcctcaccgggaccggcgtgctgaccgagagcaacaagaagttcctgccgttccagcagttcgggcgcgacatcgcggacacgaccgacgccgtgcgcgacccccagaccctggagatcctcgacatcaccccctgcagcttcggcggggtctccgtgatcacgccgggcaccaacaccagcaaccaggtggccgtcctgtaccaggacgtgaactgcaccgaggtgcccgtcgccatccacgccgaccagctgacgcccacctggcgggtgtactccaccggcagcaacgtgttccagacccgcgcggggtgcctcatcggcgccgagcacgtcaacaactcctacgagtgcgacatccccatcggggccggcatctgcgccagctaccagacgcagaccaactccccgcggcgcgcgcggagcgtggcctcccagagcatcatcgcctacaccatgtccctgggcgccgagaacagcgtggcctactccaacaacagcatcgcgatccccaccaacttcacgatctccgtcaccaccgagatcctgcccgtgagcatgaccaagacgagcgtggactgcaccatgtacatctgcggggactccaccgagtgcagcaacctcctgctgcagtacggctccttctgcacccagctcaaccgcgccctgacggggatcgccgtcgagcaggacaagaacacccaggaggtgttcgcccaggtgaagcagatctacaagacgcccccgatcaaggacttcggcgggttcaacttcagccagatcctgcccgacccctccaagcccagcaagcggtccttcatcgaggacctcctgttcaacaaggtcaccctggccgacgcgggcttcatcaagcagtacggcgactgcctcggggacatcgccgcccgcgacctgatctgcgcccagaagttcaacggcctgaccgtgctcccgcccctgctgaccgacgagatgatcgcccagtacaccagcgcgctcctggccgggaccatcacgtccggctggaccttcggggccggcgccgcgctgcagatccccttcgccatgcagatggcctaccggttcaacggcatcggggtgacccagaacgtcctctacgagaaccagaagctgatcgccaaccagttcaacagcgccatcggcaagatccaggactccctgagctccaccgcgagcgccctcgggaagctgcaggacgtggtgaaccagaacgcccaggccctgaacacgctcgtcaagcagctgtccagcaacttcggcgccatctccagcgtgctgaacgacatcctctcccgcctggacaaggtggaggcggaggtccagatcgaccggctgatcaccgggcgcctccagagcctgcagacctacgtgacccagcagctgatccgggccgccgagatccgcgccagcgccaacctcgcggccaccaagatgtccgagtgcgtgctgggccagagcaagcgggtcgacttctgcggcaaggggtaccacctgatgtccttcccccagagcgccccgcacggcgtggtgttcctccacgtcacgtacgtgcccgcccaggagaagaacttcaccaccgcgcccgccatctgccacgacgggaaggcccacttcccccgcgagggcgtcttcgtgtccaacgggacccactggttcgtgacgcagcggaacttctacgagccgcagatcatcaccaccgacaacaccttcgtcagcggcaactgcgacgtggtgatcggcatcgtcaacaacacggtgtacgaccccctgcagcccgagctggactccttcaaggaggagctcgacaagtacttcaagaaccacaccagccccgacgtggacctgggggacatctccggcatcaacgccagcgtcgtgaacatccagaaggagatcgaccgcctgaacgaggtggccaagaacctcaacgagtccctgatcgacctgcaggagctcgggaagtacgagcagtacatcaagtggccgtggtacatctggctgggcttcatcgcgggcctgatcgccatcgtcatggtgaccatcatgctctgctgcatgaccagctgctgctcctgcctgaaggggtgctgcagctgcggctcctgctgcaagttcgacgaggacgacagcgagcccgtgctgaagggggtcaagctccactacacgtga

SEQ ID NO: 11766 - RNA, 3822 nt, synthetic construct
  misc_feature 1..3822: note = SARS-CoV-2/South Korea/SNU01/2020__EPI_ISL_411929 spike protein CDS gc (1-1273)
  source 1..3822: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttctgggccctcgagcccctggtggacctgcccatcggcatcaacatcacccgcttccagaccctcctggccctgcaccggagctacctcacgccgggggactccagcagcggctggaccgcgggcgccgccgcctactacgtggggtacctgcagccccgcaccttcctgctcaagtacaacgagaacggcaccatcacggacgcggtcgactgcgccctggaccccctgtccgagaccaagtgcaccctcaagagcttcaccgtggagaaggggatctaccagacgtccaacttccgggtgcagcccaccgagagcatcgtccgcttcccgaacatcaccaacctgtgccccttcggcgaggtgttcaacgccacccggttcgcctccgtctacgcctggaaccgcaagcggatcagcaactgcgtggcggactactccgtgctgtacaacagcgcctccttcagcacgttcaagtgctacggcgtctcccccaccaagctcaacgacctgtgcttcaccaacgtgtacgccgacagcttcgtgatccgcggggacgaggtccggcagatcgcccccggccagaccgggaagatcgccgactacaactacaagctgccggacgacttcacgggctgcgtgatcgcgtggaactccaacaacctcgacagcaaggtcgggggcaactacaactacctgtaccgcctgttccggaagtccaacctcaagcccttcgagcgcgacatcagcaccgagatctaccaggccggctccaccccctgcaacggggtggagggcttcaactgctacttccccctgcagagctacgggttccagccgaccaacggcgtggggtaccagccctaccgggtggtcgtgctgtccttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgagcgtgatcacgccgggcaccaacacctccaaccaggtcgccgtgctgtaccaggacgtgaactgcaccgaggtccccgtggccatccacgccgaccagctgacgcccacctggcgggtgtacagcaccggctccaacgtcttccagacccgcgccgggtgcctcatcggcgcggagcacgtgaacaacagctacgagtgcgacatccccatcggggccggcatctgcgcctcctaccagacgcagaccaacagcccgcggcgcgcccggtccgtggcgagccagtccatcatcgcctacaccatgagcctgggcgccgagaactccgtcgcctacagcaacaactccatcgccatccccaccaacttcacgatcagcgtgaccaccgagatcctgcccgtgtccatgaccaagacgagcgtcgactgcaccatgtacatctgcggggacagcaccgagtgctccaacctcctgctgcagtacggcagcttctgcacccagctcaaccgcgcgctgacggggatcgccgtggagcaggacaagaacacccaggaggtgttcgcccaggtcaagcagatctacaagacgcccccgatcaaggacttcggcgggttcaacttctcccagatcctgcccgaccccagcaagccctccaagcggagcttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacacctccgccctcctggcggggaccatcacgagcggctggaccttcggggccggcgccgccctgcagatccccttcgcgatgcagatggcctaccggttcaacggcatcggggtcacccagaacgtgctctacgagaaccagaagctgatcgccaaccagttcaactccgccatcggcaagatccaggacagcctgtccagcaccgcctccgcgctcgggaagctgcaggacgtggtcaaccagaacgcccaggccctgaacacgctcgtgaagcagctgagctccaacttcggcgccatcagctccgtgctgaacgacatcctcagccgcctggacaaggtcgaggccgaggtgcagatcgaccggctgatcaccgggcgcctccagtccctgcagacctacgtgacccagcagctgatccgggcggccgagatccgcgccagcgccaacctcgccgcgaccaagatgagcgagtgcgtcctgggccagtccaagcgggtggacttctgcggcaaggggtaccacctgatgagcttcccccagtccgccccgcacggcgtggtcttcctccacgtgacgtacgtccccgcccaggagaagaacttcaccaccgcccccgcgatctgccacgacgggaaggcccacttcccccgcgagggcgtgttcgtgagcaacgggacccactggttcgtcacgcagcggaacttctacgagccgcagatcatcaccaccgacaacaccttcgtgtccggcaactgcgacgtggtcatcggcatcgtgaacaacacggtgtacgaccccctgcagcccgagctggacagcttcaaggaggagctcgacaagtacttcaagaaccacacctcccccgacgtcgacctgggggacatcagcggcatcaacgcctccgtggtgaacatccagaaggagatcgaccgcctgaacgaggtcgccaagaacctcaacgagagcctgatcgacctgcaggagctcgggaagtacgagcagtacatcaagtggccgtggtacatctggctgggcttcatcgccggcctgatcgcgatcgtgatggtgaccatcatgctctgctgcatgacctcctgctgcagctgcctgaaggggtgctgctcctgcggcagctgctgcaagttcgacgaggacgactccgagcccgtcctgaagggggtgaagctccactacacgtga

SEQ ID NO: 11767 - RNA, 3822 nt, synthetic construct
  misc_feature 1..3822: note = SARS-CoV-2/China/WF0004/2020__EPI_ISL_413694 spike protein CDS gc (1-1273)
  source 1..3822: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggacggagtccgagttccgggtctacagctccgccaacaactgcaccttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagacgctcctggccctgcaccggtcctacctcaccccgggggacagcagctccggctggaccgcgggcgccgccgcctactacgtggggtacctgcagccccgcaccttcctgctcaagtacaacgagaacggcacgatcaccgacgcggtcgactgcgccctggaccccctgagcgagaccaagtgcaccctcaagtccttcacggtggagaaggggatctaccagaccagcaacttccgggtgcagcccaccgagtccatcgtccgcttcccgaacatcaccaacctgtgccccttcggcgaggtgttcaacgccacgcggttcgccagcgtctacgcctggaaccgcaagcggatctccaactgcgtggcggactacagcgtgctgtacaactccgccagcttctccaccttcaagtgctacggcgtcagccccaccaagctcaacgacctgtgcttcaccaacgtgtacgccgactccttcgtgatccgcggggacgaggtccggcagatcgcccccggccagacggggaagatcgccgactacaactacaagctgccggacgacttcaccggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgacgaacggcgtggggtaccagccctaccgggtggtcgtgctgagcttcgagctcctgcacgcccccgccaccgtgtgcggccccaagaagtccaccaacctggtcaagaacaagtgcgtgaacttcaacttcaacggcctcaccgggaccggcgtgctgacggagagcaacaagaagttcctgccgttccagcagttcgggcgcgacatcgccgacaccaccgacgcggtccgcgacccccagaccctggagatcctcgacatcacgccctgcagcttcggcggggtgtccgtgatcaccccgggcaccaacaccagcaaccaggtcgccgtgctgtaccaggacgtgaactgcacggaggtccccgtggccatccacgccgaccagctgacccccacctggcgggtgtactccaccggcagcaacgtcttccagacgcgcgccgggtgcctcatcggcgcggagcacgtgaacaactcctacgagtgcgacatccccatcggggccggcatctgcgccagctaccagacccagaccaactccccgcggcgcgcccggagcgtggcgtcccagagcatcatcgcctacaccatgtccctgggcgccgagaacagcgtcgcctactccaacaacagcatcgccatccccacgaacttcaccatctccgtgaccaccgagatcctgcccgtgagcatgacgaagaccagcgtcgactgcaccatgtacatctgcggggactccaccgagtgcagcaacctcctgctgcagtacggctccttctgcacgcagctcaaccgcgcgctgaccgggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggacgatcacctccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccacggccagcgcgctcgggaagctgcaggacgtggtcaaccagaacgcccaggccctgaacaccctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgacgaagatgtccgagtgcgtcctgggccagagcaagcggttcgacttctgcggcaaggggtaccacctgatgtccttcccccagagcgccccgcacggcgtggtgttcctccacgtcacctacgtgcccgcccaggagaagaacttcaccaccgcccccgcgatctgccacgacgggaaggcccacttcccccgcgagggcgtcttcgtgtccaacgggacgcactggttcgtgacccagcggaacttctacgagccgcagatcatcaccaccgacaacacgttcgtcagcggcaactgcgacgtggtgatcggcatcgtcaacaacaccgtgtacgaccccctgcagcccgagctggactccttcaaggaggagctcgacaagtacttcaagaaccacaccagccccgacgtggacctgggggacatctccggcatcaacgccagcgtcgtgaacatccagaaggagatcgaccgcctgaacgaggtggccaagaacctcaacgagtccctgatcgacctgcaggagctcgggaagtacgagcagtacatcaagtggccgtggtacatctggctgggcttcatcgccggcctgatcgcgatcgtcatggtgaccatcatgctctgctgcatgacgagctgctgctcctgcctgaaggggtgctgcagctgcggctcctgctgcaagttcgacgaggacgacagcgagcccgtgctgaagggggtcaagctccactacacctga

SEQ ID NO: 11768 - RNA, 3822 nt, synthetic construct
  misc_feature 1..3822: note = SARS-CoV-2/China/WF0028/2020__EPI_ISL_413791 spike protein CDS gc (1-1273)
  source 1..3822: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggagtccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtga

SEQ ID NO: 11769 - RNA, 3822 nt, synthetic construct
  misc_feature 1..3822: note = SARS-CoV-2/2019-nCoV/USA-CruiseA-18/2020__MT159716.1 spike protein CDS gc (1-1273)
  source 1..3822: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagctgcgggtctacagctccgccaacaactgcacgttcgagtacgtgagccagcccttcctgatggacctcgagggcaagcaggggaacttcaagaacctgcgcgagttcgtgttcaagaacatcgacggctacttcaagatctactccaagcacaccccgatcaacctggtccgggacctcccccaggggttcagcgccctggagcccctggtggacctccccatcggcatcaacatcacccgcttccagaccctgctggccctccaccggtcctacctgacgccgggggacagcagctccggctggaccgcgggcgccgccgcctactacgtggggtacctgcagccccgcaccttcctcctgaagtacaacgagaacggcaccatcacggacgcggtcgactgcgccctggaccccctcagcgagaccaagtgcaccctgaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctctacaactccgccagcttctccacgttcaagtgctacggcgtcagccccaccaagctgaacgacctgtgcttcaccaacgtgtacgccgactccttcgtgatccgcggggacgaggtccggcagatcgcccccggccagaccgggaagatcgccgactacaactacaagctcccggacgacttcacgggctgcgtgatcgcgtggaacagcaacaacctggactccaaggtcgggggcaactacaactacctgtaccgcctcttccgcaagagcaacctgaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctcagcttcgagctgctgcacgcccccgccacggtgtgcggccccaagaagtccaccaacctcgtcaagaacaagtgcgtgaacttcaacttcaacggcctgaccgggaccggcgtgctgaccgagagcaacaagaagttcctgccgttccagcagttcgggcgcgacatcgccgacacgaccgacgcggtccgcgacccccagaccctcgagatcctggacatcaccccctgcagcttcggcggggtgtccgtgatcacgccgggcaccaacaccagcaaccaggtcgccgtgctgtaccaggacgtgaactgcaccgaggtccccgtggccatccacgccgaccagctcacgcccacctggcgggtgtactccaccggcagcaacgtcttccagacccgcgccgggtgcctgatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctccccgtgagcatgaccaagacgagcgtcgactgcaccatgtacatctgcggggactccaccgagtgcagcaacctgctgctccagtacggctccttctgcacccagctgaaccgcgcgctgacggggatcgccgtggagcaggacaagaacacccaggaggtgttcgcccaggtcaagcagatctacaagacgcccccgatcaaggacttcggcgggttcaacttcagccagatcctccccgacccctccaagcccagcaagcggtccttcatcgaggacctgctgttcaacaaggtgaccctcgccgacgccggcttcatcaagcagtacggcgactgcctgggggacatcgcggcccgcgacctgatctgcgcccagaagttcaacggcctcaccgtgctgccgcccctgctcaccgacgagatgatcgcccagtacaccagcgccctgctggcggggaccatcacgtccggctggaccttcggggccggcgccgccctccagatccccttcgcgatgcagatggcctaccggttcaacggcatcggggtcacccagaacgtgctgtacgagaaccagaagctgatcgccaaccagttcaacagcgccatcggcaagatccaggactccctcagctccaccgccagcgcgctggggaagctgcaggacgtggtcaaccagaacgcccaggccctcaacacgctggtgaagcagctgtccagcaacttcggcgccatctccagcgtgctcaacgacatcctgtcccgcctggacaaggtcgaggccgaggtgcagatcgaccggctcatcaccgggcgcctgcagagcctgcagacctacgtgacccagcagctcatccgggcggccgagatccgcgccagcgccaacctggccgcgaccaagatgtccgagtgcgtcctgggccagagcaagcgggtggacttctgcggcaaggggtaccacctcatgtccttcccccagagcgccccgcacggcgtggtcttcctgcacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctcgactccttcaaggaggagctggacaagtacttcaagaaccacaccagccccgacgtcgacctgggggacatctccggcatcaacgccagcgtggtgaacatccagaaggagatcgaccgcctcaacgaggtcgccaagaacctgaacgagtccctgatcgacctccaggagctggggaagtacgagcagtacatcaagtggccgtggtacatctggctgggcttcatcgccggcctcatcgcgatcgtgatggtgaccatcatgctgtgctgcatgaccagctgctgctcctgcctgaaggggtgctgcagctgcggctcctgctgcaagttcgacgaggacgacagcgagcccgtcctcaagggggtgaagctgcactacacgtga

SEQ ID NO: 11770 - RNA, 3822 nt, synthetic construct
  misc_feature 1..3822: note SARS-CoV-2/SARS-CoV-2/Yunnan-01/human/2020/CHN__MT049951.1 spike protein CDS gc (1-1273)
  source 1..3822: mol_type = other RNA
atgttcgtgttcctggtcctcctgcccctggtgagctcccagtgcgtgaacctcaccacccgcacgcagctgccgcccgccaacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtga

SEQ ID NO: 11771 - RNA, 3822 nt, synthetic construct
  misc_feature 1..3822: note = SARS-CoV-2/USA/WA-UW292/2020__EPI_ISL_418077 spike protein CDS gc (1-1273)
  source 1..3822: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccagctccaccccctgcaacggcgtggaggggttcaactgctacttccccctgcagagctacggcttccagccgaccaacggggtgggctaccagccctaccgggtggtcgtgctgagcttcgagctcctgcacgcccccgccacggtgtgcgggcccaagaagtccaccaacctggtcaagaacaagtgcgtgaacttcaacttcaacggcctcaccggcaccggggtgctgaccgagagcaacaagaagttcctgccgttccagcagttcggccgcgacatcgccgacacgaccgacgcggtccgcgacccccagaccctggagatcctcgacatcaccccctgctccttcgggggcgtgagcgtgatcacgccggggaccaacacctccaaccaggtcgccgtgctgtaccaggacgtgaactgcaccgaggtccccgtggccatccacgccgaccagctgacgcccacctggcgggtgtacagcaccggctccaacgtcttccagacccgcgccggctgcctcatcggggcggagcacgtgaacaacagctacgagtgcgacatccccatcggcgccgggatctgcgcctcctaccagacgcagaccaacagcccgcggcgcgcccggtccgtggcgagccagtccatcatcgcctacaccatgagcctgggcgccgagaactccgtcgcctacagcaacaactccatcgccatccccaccaacttcacgatcagcgtgaccaccgagatcctgcccgtgagcatgaccaagacgtccgtcgactgcaccatgtacatctgcggcgacagcaccgagtgctccaacctcctgctgcagtacgggagcttctgcacccagctcaaccgcgcgctgacgggcatcgccgtggagcaggacaagaacacccaggaggtgttcgcccaggtcaagcagatctacaagacgcccccgatcaaggacttcgggggcttcaacttctcccagatcctgcccgaccccagcaagccctccaagcggagcttcatcgaggacctcctgttcaacaaggtgaccctggccgacgccgggttcatcaagcagtacggcgactgcctcggcgacatcgcggcccgcgacctgatctgcgcccagaagttcaacgggctgaccgtgctcccgcccctgctgaccgacgagatgatcgcccagtacacctccgccctcctggcgggcaccatcacgagcgggtggaccttcggcgccggggccgccctgcagatccccttcgcgatgcagatggcctaccggttcaacggcatcggcgtcacccagaacgtgctctacgagaaccagaagctgatcgccaaccagttcaactccgccatcgggaagatccaggacagcctgtccagcaccgcctccgcgctcggcaagctgcaggacgtggtcaaccagaacgcccaggccctgaacacgctcgtgaagcagctgagctccaacttcggggccatcagctccgtgctgaacgacatcctcagccgcctggacaaggtcgaggccgaggtgcagatcgaccggctgatcaccggccgcctccagagcctgcagacctacgtgacccagcagctgatccgggcggccgagatccgcgcctccgccaacctcgccgcgaccaagatgagcgagtgcgtcctggggcagtccaagcgggtggacttctgcggcaagggctaccacctgatgagcttcccccagtccgccccgcacggggtggtcttcctccacgtgacgtacgtccccgcccaggagaagaacttcaccaccgcccccgcgatctgccacgacggcaaggcccacttcccccgcgagggggtgttcgtgagcaacggcacccactggttcgtcacgcagcggaacttctacgagccgcagatcatcaccaccgacaacaccttcgtgtccgggaactgcgacgtggtcatcggcatcgtgaacaacacggtgtacgaccccctgcagcccgagctggacagcttcaaggaggagctcgacaagtacttcaagaaccacacctcccccgacgtcgacctgggcgacatcagcgggatcaacgcctccgtggtgaacatccagaaggagatcgaccgcctgaacgaggtcgccaagaacctcaacgagagcctgatcgacctgcaggagctcggcaagtacgagcagtacatcaagtggccgtggtacatctggctggggttcatcgccggcctgatcgcgatcgtgatggtgaccatcatgctctgctgcatgacctcctgctgcagctgcctgaagggctgctgctcctgcgggagctgctgcaagttcgacgaggacgactccgagcccgtcctgaagggcgtgaagctccactacacgtga

SEQ ID NO: 11772 - RNA, 3822 nt, synthetic construct
  misc_feature 1..3822: note = SARS-CoV-2/Iceland/192/2020__EPI_ISL_417819 spike protein CDS gc (1-1273)
  source 1..3822: mol_type = other RNA
atgttcgtgttcttcgtcctgctccccctggtgagctcccagtgcgtgaacctgaccacccgcacgcagctcccgcccgcctacaccaacagcttcacccggggcgtctactaccccgacaaggtgttccgctccagcgtgctgcactccacccaggacctgttcctccccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctggacagcaagacccagtccctcctgatcgtgaacaacgccaccaacgtggtcatcaaggtgtgcgagttccagttctgcaacgaccccttcctgggcgtgtactaccacaagaacaacaagagctggatggagtccgagttccgggtctacagctccgccaacaactgcacgttcgagtacgtgagccagcccttcctcatggacctggagggcaagcaggggaacttcaagaacctgcgcgagttcgtgttcaagaacatcgacggctacttcaagatctactccaagcacaccccgatcaacctcgtccgggacctgccccaggggttcagcgccctggagcccctcgtggacctgcccatcggcatcaacatcacccgcttccagaccctgctcgccctgcaccggtcctacctgacgccgggggacagcagctccggctggaccgcgggcgccgccgcctactacgtggggtacctccagccccgcaccttcctgctgaagtacaacgagaacggcaccatcacggacgcggtcgactgcgccctcgaccccctgagcgagaccaagtgcaccctgaagtccttcaccgtggagaaggggatctaccagacgagcaacttccgggtgcagcccaccgagtccatcgtccgcttcccgaacatcaccaacctctgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctgaacgacctctgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctggactccaaggtcgggggcaactacaactacctctaccgcctgttccgcaagagcaacctgaagcccttcgagcgggacatctccaccgagatctaccaggccggcagcaccccctgcaacggggtggagggcttcaactgctacttccccctccagtcctacgggttccagccgaccaacggcgtggggtaccagccctaccgggtggtcgtgctgagcttcgagctgctccacgcccccgccacggtgtgcggccccaagaagtccaccaacctggtcaagaacaagtgcgtgaacttcaacttcaacggcctgaccgggaccggcgtgctcaccgagagcaacaagaagttcctgccgttccagcagttcgggcgcgacatcgccgacacgaccgacgcggtccgcgacccccagaccctggagatcctggacatcaccccctgcagcttcggcggggtgtccgtgatcacgccgggcaccaacaccagcaaccaggtcgccgtgctctaccagggcgtgaactgcaccgaggtccccgtggccatccacgccgaccagctgacgcccacctggcgggtgtactccaccgggagcaacgtcttccagacccgcgccggctgcctgatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctcggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctgctcctgcagtacgggtccttctgcacccagctgaaccgcgcgctcacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctgggcgacatcgcggcccgcgacctcatctgcgcccagaagttcaacgggctgaccgtgctgccgcccctcctgaccgacgagatgatcgcccagtacaccagcgccctgctcgcgggcaccatcacgtccgggtggaccttcggcgccggcgccgccctgcagatccccttcgcgatgcagatggcctaccggttcaacgggatcggcgtcacccagaacgtgctgtacgagaaccagaagctcatcgccaaccagttcaacagcgccatcgggaagatccaggactccctgagctccaccgccagcgcgctgggcaagctccaggacgtggtcaaccagaacgcccaggccctgaacacgctggtgaagcagctctccagcaacttcggggccatctccagcgtgctgaacgacatcctgtcccgcctcgacaaggtcgaggccgaggtgcagatcgaccggctgatcaccggccgcctgcagagcctccagacctacgtgacccagcagctgatccgggcggccgagatccgcgccagcgccaacctggccgcgaccaagatgtccgagtgcgtcctcggccagagcaagcgggtggacttctgcgggaagggctaccacctgatgtccttcccccagagcgccccgcacggggtggtcttcctgcacgtgacgtacgtccccgcccaggagaagaacttcaccaccgcccccgcgatctgccacgacggcaaggcccacttcccccgcgagggggtgttcgtgtccaacggcacccactggttcgtcacgcagcggaacttctacgagccgcagatcatcaccaccgacaacaccttcgtgagcggcaactgcgacgtggtcatcgggatcgtgaacaacacggtgtacgaccccctccagcccgagctggactccttcaaggaggagctggacaagtacttcaagaaccacaccagccccgacgtcgacctcggcgacatctccgggatcaacgccagcgtggtgaacatccagaaggagatcgaccgcctgaacgaggtcgccaagaacctgaacgagtccctcatcgacctgcaggagctgggcaagtacgagcagtacatcaagtggccgtggtacatctggctcggcttcatcgccgggctgatcgcgatcgtgatggtgaccatcatgctgtgctgcatgaccagctgctgctcctgcctcaagggctgctgcagctgcgggtcctgctgcaagttcgacgaggacgacagcgagcccgtcctgaagggcgtgaagctgcactacacgtga

SEQ ID NO: 11773 - RNA, 3822 nt, synthetic construct
  misc_feature 1..3822: note = SARS-CoV-2/Belgium/ULG-6939/2020__EPI_ISL_417020 spike protein CDS gc (1-1273)
  source 1..3822: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgtgtactccaacaacagcatcgccatccccaccaacttcacgatctccgtgaccaccgagatcctgcccgtcagcatgaccaagacgagcgtggactgcaccatgtacatctgcggcgactccaccgagtgcagcaacctcctgctgcagtacgggtccttctgcacccagctcaaccgcgccctgacgggcatcgcggtggagcaggacaagaacacccaggaggtcttcgcccaggtgaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgccgcgcgcgacctgatctgcgcccagaagttcaacgggctgaccgtcctcccgcccctgctgaccgacgagatgatcgcccagtacaccagcgccctcctggccggcaccatcacgtccgggtggaccttcggcgcgggcgccgccctgcagatccccttcgccatgcagatggcgtaccggttcaacgggatcggcgtgacccagaacgtgctctacgagaaccagaagctgatcgccaaccagttcaacagcgccatcgggaagatccaggactccctgagctccaccgccagcgccctcggcaagctgcaggacgtcgtgaaccagaacgcgcaggccctgaacacgctcgtgaagcagctgtccagcaacttcggggccatctccagcgtcctgaacgacatcctctcccgcctggacaaggtggaggccgaggtgcagatcgaccggctgatcaccggccgcctccagagcctgcagacctacgtcacccagcagctgatccgggccgcggagatccgcgccagcgccaacctcgccgccaccaagatgtccgagtgcgtgctgggccagagcaagcgggtggacttctgcgggaagggctaccacctgatgtccttcccccagagcgcgccgcacggggtcgtgttcctccacgtcacgtacgtgcccgcccaggagaagaacttcaccaccgcccccgccatctgccacgacggcaaggcgcacttcccccgcgagggggtgttcgtctccaacggcacccactggttcgtgacgcagcggaacttctacgagccgcagatcatcaccaccgacaacaccttcgtgagcggcaactgcgacgtcgtgatcgggatcgtgaacaacacggtctacgaccccctgcagcccgagctggactccttcaaggaggagctcgacaagtacttcaagaaccacaccagccccgacgtggacctgggcgacatctccgggatcaacgccagcgtggtcaacatccagaaggagatcgaccgcctgaacgaggtggccaagaacctcaacgagtccctgatcgacctgcaggagctcggcaagtacgagcagtacatcaagtggccgtggtacatctggctgggcttcatcgccgggctgatcgccatcgtgatggtcaccatcatgctctgctgcatgaccagctgctgctcctgcctgaagggctgctgcagctgcgggtcctgctgcaagttcgacgaggacgacagcgagcccgtgctgaagggcgtgaagctccactacacgtga

SEQ ID NO: 11774 - RNA, 3822 nt, synthetic construct
  misc_feature 1..3822: note = SARS-CoV-2/France/HF2496/2020__EPI_ISL_418231 spike protein CDS gc (1-1273)
  source 1..3822: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgtggcgcgcgacctgatctgcgcccagaagttcaacgggctgaccgtcctcccgcccctgctgaccgacgagatgatcgcccagtacaccagcgccctcctggccggcaccatcacgtccgggtggaccttcggcgcgggcgccgccctgcagatccccttcgccatgcagatggcgtaccggttcaacgggatcggcgtgacccagaacgtgctctacgagaaccagaagctgatcgccaaccagttcaacagcgccatcgggaagatccaggactccctgagctccaccgccagcgccctcggcaagctgcaggacgtcgtgaaccagaacgcgcaggccctgaacacgctcgtgaagcagctgtccagcaacttcggggccatctccagcgtcctgaacgacatcctctcccgcctggacaaggtggaggccgaggtgcagatcgaccggctgatcaccggccgcctccagagcctgcagacctacgtcacccagcagctgatccgggccgcggagatccgcgccagcgccaacctcgccgccaccaagatgtccgagtgcgtgctgggccagagcaagcgggtggacttctgcgggaagggctaccacctgatgtccttcccccagagcgcgccgcacggggtcgtgttcctccacgtcacgtacgtgcccgcccaggagaagaacttcaccaccgcccccgccatctgccacgacggcaaggcgcacttcccccgcgagggggtgttcgtctccaacggcacccactggttcgtgacgcagcggaacttctacgagccgcagatcatcaccaccgacaacaccttcgtgagcggcaactgcgacgtcgtgatcgggatcgtgaacaacacggtctacgaccccctgcagcccgagctggactccttcaaggaggagctcgacaagtacttcaagaaccacaccagccccgacgtggacctgggcgacatctccgggatcaacgccagcgtggtcaacatccagaaggagatcgaccgcctgaacgaggtggccaagaacctcaacgagtccctgatcgacctgcaggagctcggcaagtacgagcagtacatcaagtggccgtggtacatctggctgggcttcatcgccgggctgatcgccatcgtgatggtcaccatcatgctctgctgcatgaccagctgctgctcctgcctgaagggctgctgcagctgcgggtcctgctgcaagttcgacgaggacgacagcgagcccgtgctgaagggcgtgaagctccactacacgtga

SEQ ID NO: 11775 - RNA, 3822 nt, synthetic construct
  misc_feature 1..3822: note = SARS-CoV-2/USA/WA-UW291/2020__EPI_ISL_418076 spike protein CDS gc (1-1273)
  source 1..3822: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccagtactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacaaggtcgaggccgaggtgcagatcgaccggctgatcaccggccgcctccagagcctgcagacctacgtgacccagcagctgatccgggcggccgagatccgcgccagcgccaacctcgccgcgaccaagatgtccgagtgcgtcctgggccagagcaagcgggtggacttctgcgggaagggctaccacctgatgtccttcccccagagcgccccgcacggggtggtcttcctccacgtgacgtacgtccccgcccaggagaagaacttcaccaccgcccccgcgatctgccacgacggcaaggcccacttcccccgcgagggggtgttcgtgtccaacggcacccactggttcgtcacgcagcggaacttctacgagccgcagatcatcaccaccgacaacaccttcgtgagcggcaactgcgacgtggtcatcgggatcgtgaacaacacggtgtacgaccccctgcagcccgagctggactccttcaaggaggagctcgacaagtacttcaagaaccacaccagccccgacgtcgacctgggcgacatctccgggatcaacgccagcgtggtgaacatccagaaggagatcgaccgcctgaacgaggtcgccaagaacctcaacgagtccctgatcgacctgcaggagctcggcaagtacgagcagtacatcaagtggccgtggtacatctggctgggcttcatcgccgggctgatcgcgatcgtgatggtgaccatcatgctctgctgcatgaccagctgctgctcctgcctgaagggctgctgcagctgcgggtcctgctgcaagttcgacgaggacgacagcgagcccgtcctgaagggcgtgaagctccactacacgtga

SEQ ID NO: 11776 - RNA, 3822 nt, synthetic construct
  misc_feature 1..3822: note = SARS-CoV-2/Portugal/PT0034/2020__EPI_ISL_418019 spike protein CDS gc (1-1273)
  source 1..3822: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacaaggtcgaggccgaggtgcagatcgaccggctgatcaccggccgcctccagagcctgcagacctacgtgacccagcagctgatccgggcggccgagatccgcgccagcgccaacctcgccgcgaccaagatgtccgagtgcgtcctgggccagagcaagcgggtggacttctgcgggaagggctaccacctgatgtccttcccccagagcgccccgcacggggtggtcttcctccacgtgacgtacgtccccgcccaggagaagaacttcaccaccgcccccgcgatctgccacgacggcaaggcccacttcccccgcgagggggtgttcgtgtccaacggcacccactggttcgtcacgcagcggaacttctacgagccgcagatcatcaccaccgacaacaccttcgtgagcggcaactgcgacgtggtcatcgggatcgtgaacaacacggtgtacgaccccctgcagcccgagctggactccttcaaggaggagctcgacaagtacttcaagaaccacaccagccccgacgtcgacctgggcgacatctccgggatcaacgccagcgtggtgaacatccagaaggagatcgaccgcctgaacgaggtcgccaagaacctcaacgagtccctgatcgacctgcaggagctcggcaagtacgagcagtacatcaagtggccgtggtacatctggctgggcttcatcgccgggctgatcgcgatcgtgatggtgaccatcatgctctgctgcatcaccagctgctgctcctgcctgaagggctgctgcagctgcgggtcctgctgcaagttcgacgaggacgacagcgagcccgtcctgaagggcgtgaagctccactacacgtga

SEQ ID NO: 11777 - RNA, 3822 nt, synthetic construct
  misc_feature 1..3822: note = SARS-CoV-2/Iceland/202/2020__EPI_ISL_417750 spike protein CDS gc (1-1273)
  source 1..3822: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatcccgggcatcaacgcctccgtggtgaacatccagaaggagatcgaccgcctgaacgaggtcgccaagaacctcaacgagagcctgatcgacctgcaggagctcgggaagtacgagcagtacatcaagtggccctggtacatctggctgggcttcatcgccggcctgatcgcgatcgtgatggtgaccatcatgctctgctgcatgacctcctgctgcagctgcctgaaggggtgctgctcctgcggcagctgctgcaagttcgacgaggacgactccgagcccgtcctgaagggggtgaagctccactacacgtga

SEQ ID NO: 11778 - RNA, 3822 nt, synthetic construct
  misc_feature 1..3822: note = SARS-CoV-2/USA/WA-UW261/2020__EPI_ISL_418046 spike protein CDS gc (1-1273)
  source 1..3822: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcacgagcgtctacgcctggaaccgcaagcggatctccaactgcgtggccgactacagcgtgctgtacaactccgcgagcttctccaccttcaagtgctacggcgtcagccccaccaagctcaacgacctgtgcttcaccaacgtgtacgccgactccttcgtgatccgcggggacgaggtccggcagatcgcccccggccagacggggaagatcgccgactacaactacaagctgccggacgacttcaccggctgcgtgatcgcctggaacagcaacaacctcgactccaaggtcgggggcaactacaactacctgtaccgcctgttccgcaagagcaacctcaagcccttcgagcgggacatctccaccgagatctaccaggcgggcagcaccccctgcaacggggtggagggcttcaactgctacttccccctgcagtcctacgggttccagccgacgaacggcgtggggtaccagccctaccgggtggtcgtgctgagcttcgagctcctgcacgcccccgccaccgtgtgcggccccaagaagtccaccaacctggtcaagaacaagtgcgtgaacttcaacttcaacggcctcaccgggaccggcgtgctgacggagagcaacaagaagttcctgccgttccagcagttcgggcgcgacatcgccgacaccaccgacgccgtccgcgacccccagaccctggagatcctcgacatcacgccctgcagcttcggcggggtgtccgtgatcaccccgggcaccaacaccagcaaccaggtcgcggtgctgtaccaggacgtgaactgcacggaggtccccgtggccatccacgccgaccagctgacccccacctggcgggtgtactccaccggcagcaacgtcttccagacgcgcgccgggtgcctcatcggcgccgagcacgtgaacaactcctacgagtgcgacatccccatcggggcgggcatctgcgccagctaccagacccagaccaactccccgcggcgcgcccggagcgtggcctcccagagcatcatcgcgtacaccatgtccctgggcgccgagaacagcgtcgcctactccaacaacagcatcgccatccccacgaacttcaccatctccgtgaccaccgagatcctgcccgtgagcatgacgaagaccagcgtcgactgcaccatgtacatctgcggggactccaccgagtgcagcaacctcctgctgcagtacggctccttctgcacgcagctcaaccgcgccctgaccgggatcgcggtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgccgcgcgcgacctgatctgcgcccagaagttcaacggcctgaccgtgctcccgcccctgctgaccgacgagatgatcgcccagtacaccagcgccctcctggccgggacgatcacctccggctggaccttcggggcgggcgccgccctgcagatccccttcgccatgcagatggcgtaccggttcaacggcatcggggtcacccagaacgtgctctacgagaaccagaagctgatcgccaaccagttcaacagcgccatcggcaagatccaggactccctgagctccacggccagcgccctcgggaagctgcaggacgtggtcaaccagaacgcgcaggccctgaacaccctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggccgcggagatccgcgccagcgccaacctcgccgccacgaagatgtccgagtgcgtcctgggccagagcaagcgggtggacttctgcggcaaggggtaccacctgatgtccttcccccagagcgcgccgcacggcgtggtcttcctccacgtgacctacgtccccgcccaggagaagaacttcaccaccgcccccgccatctgccacgacgggaaggcgcacttcccccgcgagggcgtgttcgtgtccaacgggacgcactggttcgtcacccagcggaacttctacgagccgcagatcatcaccaccgacaacacgttcgtgagcggcaactgcgacgtggtcatcggcatcgtgaacaacaccgtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgccatcgtgatggtgaccatcatgctctgctgcatgacgagctgctgctcctgcctgaaggggtgctgcagctgcggctcctgctgcaagttcgacgaggacgacagcgagcccgtcctgaagggggtgaagctccactacacctga

SEQ ID NO: 11779 - RNA, 3822 nt, synthetic construct
  misc_feature 1..3822: note = SARS-CoV-2/Portugal/PT0035/2020__EPI_ISL_418020 spike protein CDS gc (1-1273)
  source 1..3822: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcagcgcgcgcgacctgatctgcgcccagaagttcaacggcctgaccgtgctcccgcccctgctgaccgacgagatgatcgcccagtacacctccgccctcctggccgggaccatcacgagcggctggaccttcggggcgggcgccgccctgcagatccccttcgccatgcagatggcgtaccggttcaacggcatcggggtcacccagaacgtgctctacgagaaccagaagctgatcgccaaccagttcaactccgccatcggcaagatccaggacagcctgtccagcaccgcctccgccctcgggaagctgcaggacgtggtcaaccagaacgcgcaggccctgaacacgctcgtgaagcagctgagctccaacttcggcgccatcagctccgtgctgaacgacatcctcagccgcctggacaaggtcgaggccgaggtgcagatcgaccggctgatcaccgggcgcctccagagcctgcagacctacgtgacccagcagctgatccgggccgcggagatccgcgcctccgccaacctcgccgccaccaagatgagcgagtgcgtcctgggccagtccaagcgggtggacttctgcggcaaggggtaccacctgatgagcttcccccagtccgcgccgcacggcgtggtcttcctccacgtgacgtacgtccccgcccaggagaagaacttcaccaccgcccccgccatctgccacgacgggaaggcgcacttcccccgcgagggcgtgttcgtgagcaacgggacccactggttcgtcacgcagcggaacttctacgagccgcagatcatcaccaccgacaacaccttcgtgtccggcaactgcgacgtggtcatcggcatcgtgaacaacacggtgtacgaccccctgcagcccgagctggacagcttcaaggaggagctcgacaagtacttcaagaaccacacctcccccgacgtcgacctgggggacatcagcggcatcaacgcctccgtggtgaacatccagaaggagatcgaccgcctgaacgaggtcgccaagaacctcaacgagagcctgatcgacctgcaggagctcgggaagtacgagcagtacatcaagtggccgtggtacatctggctgggcttcatcgccggcctgatcgccatcgtgatggtgaccatcatgctctgctgcatgacctcctgctgcagctgcctgaaggggtgctgctcctgcggcagctgctgcaagttcgacgaggacgactccgagcccgtcctgaagggggtgaagctccactacacgtga

SEQ ID NO: 11780 - RNA, 3822 nt, synthetic construct
  misc_feature 1..3822: note = SARS-CoV-2/USA/NY-NYUMC7/2020__EPI_ISL_418192 spike protein CDS gc (1-1273)
  source 1..3822: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtaccaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacaaggtcgaggccgaggtgcagatcgaccggctgatcaccggccgcctccagagcctgcagacctacgtgacccagcagctgatccgggcggccgagatccgcgccagcgccaacctcgccgcgaccaagatgtccgagtgcgtcctgggccagagcaagcgggtggacttctgcgggaagggctaccacctgatgtccttcccccagagcgccccgcacggggtggtcttcctccacgtgacgtacgtccccgcccaggagaagaacttcaccaccgcccccgcgatctgccacgacggcaaggcccacttcccccgcgagggggtgttcgtgtccaacggcacccactggttcgtcacgcagcggaacttctacgagccgcagatcatcaccaccgacaacaccttcgtgagcggcaactgcgacgtggtcatcgggatcgtgaacaacacggtgtacgaccccctgcagcccgagctggactccttcaaggaggagctcgacaagtacttcaagaaccacaccagccccgacgtcgacctgggcgacatctccgggatcaacgccagcgtggtgaacatccagaaggagatcgaccgcctgaacgaggtcgccaagaacctcaacgagtccctgatcgacctgcaggagctcggcaagtacgagcagtacatcaagtggccgtggtacatctggctgggcttcatcgccgggctgatcgcgatcgtgatggtgaccatcatgctctgctgcatgaccagctgctgctcctgcctgaagggctgctgcagctgcgggtcctgctgcaagttcgacgaggacgacagcgagcccgtcctgaagggcgtgaagctccactacacgtga

SEQ ID NO: 11781 - RNA, 3822 nt, synthetic construct
  misc_feature 1..3822: note = SARS-CoV-2/Iceland/189/2020__EPI_ISL_417709 spike protein CDS gc (1-1273)
  source 1..3822: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcaccaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcacgatcacctccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccacggccagcgcgctcggcaagctgcaggacgtggtcaaccagaacgcccaggccctgaacaccctcgtgaagcagctgtccagcaacttcggggccatctccagcgtgctgaacgacatcctctcccgcctggacaaggtcgaggccgaggtgcagatcgaccggctgatcaccggccgcctccagagcctgcagacctacgtgacccagcagctgatccgggcggccgagatccgcgccagcgccaacctcgccgcgacgaagatgtccgagtgcgtcctgggccagagcaagcgggtggacttctgcgggaagggctaccacctgatgtccttcccccagagcgccccgcacggggtggtcttcctccacgtgacctacgtccccgcccaggagaagaacttcaccaccgcccccgcgatctgccacgacggcaaggcccacttcccccgcgagggggtgttcgtgtccaacggcacgcactggttcgtcacccagcggaacttctacgagccgcagatcatcaccaccgacaacacgttcgtgagcggcaactgcgacgtggtcatcgggatcgtgaacaacaccgtgtacgaccccctgcagcccgagctggactccttcaaggaggagctcgacaagtacttcaagaaccacaccagccccgacgtcgacctgggcgacatctccgggatcaacgccagcgtggtgaacatccagaaggagatcgaccgcctgaacgaggtcgccaagaacctcaacgagtccctgatcgacctgcaggagctcggcaagtacgagcagtacatcaagtggccgtggtacatctggctgggcttcatcgccgggctgatcgcgatcgtgatggtgaccatcatgctctgctgcatgacgagctgctgctcctgcctgaagggctgctgcagctgcgggtcctgctgcaagttcgacgaggacgacagcgagcccgtcctgaagggcgtgaagctccactacacctga

SEQ ID NO: 11782 - RNA, 3822 nt, synthetic construct
  misc_feature 1..3822: note = SARS-CoV-2/Australia/NSW56/2020__EPI_ISL_417408 spike protein CDS gc (1-1273)
  source 1..3822: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgactccagcaagccctccaagcggagcttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctgcccccgctcctgaccgacgagatgatcgcccagtacacctccgccctcctggcggggaccatcacgagcggctggaccttcggggccggcgccgccctgcagatccccttcgcgatgcagatggcctaccggttcaacggcatcggggtcacccagaacgtgctctacgagaaccagaagctgatcgccaaccagttcaactccgccatcggcaagatccaggacagcctgtccagcaccgcctccgcgctcgggaagctgcaggacgtggtcaaccagaacgcccaggccctgaacacgctcgtgaagcagctgagctccaacttcggcgccatcagctccgtgctgaacgacatcctcagccgcctggacaaggtcgaggccgaggtgcagatcgaccggctgatcaccgggcgcctccagagcctgcagacctacgtgacccagcagctgatccgggcggccgagatccgcgcctccgccaacctcgccgcgaccaagatgagcgagtgcgtcctgggccagtccaagcgggtggacttctgcggcaaggggtaccacctgatgagcttcccccagtccgcgccccacggcgtggtcttcctccacgtgacgtacgtcccggcccaggagaagaacttcaccaccgcccccgccatctgccacgacgggaaggcccacttcccccgcgagggcgtgttcgtgagcaacgggacccactggttcgtcacgcagcggaacttctacgagccccagatcatcaccaccgacaacaccttcgtgtccggcaactgcgacgtggtcatcggcatcgtgaacaacacggtgtacgacccgctgcagcccgagctggacagcttcaaggaggagctcgacaagtacttcaagaaccacacctcccccgacgtcgacctgggggacatcagcggcatcaacgcctccgtggtgaacatccagaaggagatcgaccgcctgaacgaggtcgccaagaacctcaacgagagcctgatcgacctgcaggagctcgggaagtacgagcagtacatcaagtggccctggtacatctggctgggcttcatcgccggcctgatcgcgatcgtgatggtgaccatcatgctctgctgcatgacctcctgctgcagctgcctgaaggggtgctgctcctgcggcagctgctgcaagttcgacgaggacgactccgagccggtcctgaagggggtgaagctccactacacgtga

SEQ ID NO: 11783 - RNA, 3822 nt, synthetic construct
  misc_feature 1..3822: note = SARS-CoV-2/Iceland/280/2020__EPI_ISL_417608 spike protein CDS gc (1-1273)
  source 1..3822: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccacacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacaaggtcgaggccgaggtgcagatcgaccggctgatcaccggccgcctccagagcctgcagacctacgtgacccagcagctgatccgggcggccgagatccgcgccagcgccaacctcgccgcgaccaagatgtccgagtgcgtcctgggccagagcaagcgggtggacttctgcgggaagggctaccacctgatgtccttcccccagagcgccccgcacggggtggtcttcctccacgtgacgtacgtccccgcccaggagaagaacttcaccaccgcccccgcgatctgccacgacggcaaggcccacttcccccgcgagggggtgttcgtgtccaacggcacccactggttcgtcacgcagcggaacttctacgagccgcagatcatcaccaccgacaacaccttcgtgagcggcaactgcgacgtggtcatcgggatcgtgaacaacacggtgtacgaccccctgcagcccgagctggactccttcaaggaggagctcgacaagtacttcaagaaccacaccagccccgacgtcgacctgggcgacatctccgggatcaacgccagcgtggtgaacatccagaaggagatcgaccgcctgaacgaggtcgccaagaacctcaacgagtccctgatcgacctgcaggagctcggcaagtacgagcagtacatcaagtggccgtggtacatctggctgggcttcatcgccgggctgatcgcgatcgtgatggtgaccatcatgctctgctgcatgaccagctgctgctcctgcctgaagggctgctgcagctgcgggtcctgctgcaagttcgacgaggacgacagcgagcccgtcctgaagggcgtgaagctccactacacgtga

SEQ ID NO: 11784 - RNA, 3822 nt, synthetic construct
  misc_feature 1..3822: note = SARS-CoV-2/Iceland/247/2020__EPI_ISL_417575 spike protein CDS gc (1-1273)
  source 1..3822: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacaaggtcgaggccgaggtgcagatcgaccggctgatcaccggccgcctccagagcctgcagacctacgtgacccagcagctgatccgggcggccgagatccgcgccagcgccaacctcgccgcgaccaagatgtccgagtgcgtcctgggccagagcaagcgggtggacttctgcgggaagggctaccacctgatgtccttcccccagagcgccccgcacggggtggtcttcctccacgtgacgtacgtccccgcccaggagaagaacttcaccaccgcccccgcgatctgccacgacggcaaggcccacttcccccgcgagggggtgttcgtgtccaacggcacccactggttcgtcacgcagcggaacttctacgagccgcagatcatcaccaccgacaacaccttcgtgagcggcaactgcgacgtggtcatcgggatcgtgaacaacacggtgtacgaccccctgcagcccgagctggactccttcaaggaggagctcgacaagtacttcaagaaccacaccagccccgacgtcgacctgggcgacatctccgggatcaacgccagcgtggtgaacatccagaaggagatcgaccgcctgaacgaggtcgccaagaacctcaacgagtccctgatcgacctgcaggagctcggcaagtacgagcagtacatcaagtggccgtggtacatctggctgggcttcatcgccgggctgatcgcgatcgtgatcgtgaccatcatgctctgctgcatgaccagctgctgctcctgcctgaagggctgctgcagctgcgggtcctgctgcaagttcgacgaggacgacagcgagcccgtcctgaagggcgtgaagctccactacacgtga

SEQ ID NO: 11785 - RNA, 3822 nt, synthetic construct
  misc_feature 1..3822: note = SARS-CoV-2/Iceland/238/2020__EPI_ISL_417566 spike protein CDS gc (1-1273)
  source 1..3822: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgtgggcttcatcaagcagtacggggactgcctcggcgacatcgccgcgcgcgacctgatctgcgcccagaagttcaacgggctgaccgtcctcccgcccctgctgaccgacgagatgatcgcccagtacaccagcgccctcctggccggcaccatcacgtccgggtggaccttcggcgcgggcgccgccctgcagatccccttcgccatgcagatggcgtaccggttcaacgggatcggcgtgacccagaacgtgctctacgagaaccagaagctgatcgccaaccagttcaacagcgccatcgggaagatccaggactccctgagctccaccgccagcgccctcggcaagctgcaggacgtcgtgaaccagaacgcgcaggccctgaacacgctcgtgaagcagctgtccagcaacttcggggccatctccagcgtcctgaacgacatcctctcccgcctggacaaggtggaggccgaggtgcagatcgaccggctgatcaccggccgcctccagagcctgcagacctacgtcacccagcagctgatccgggccgcggagatccgcgccagcgccaacctcgccgccaccaagatgtccgagtgcgtgctgggccagagcaagcgggtggacttctgcgggaagggctaccacctgatgtccttcccccagagcgcgccgcacggggtcgtgttcctccacgtcacgtacgtgcccgcccaggagaagaacttcaccaccgcccccgccatctgccacgacggcaaggcgcacttcccccgcgagggggtgttcgtctccaacggcacccactggttcgtgacgcagcggaacttctacgagccgcagatcatcaccaccgacaacaccttcgtgagcggcaactgcgacgtcgtgatcgggatcgtgaacaacacggtctacgaccccctgcagcccgagctggactccttcaaggaggagctcgacaagtacttcaagaaccacaccagccccgacgtggacctgggcgacatctccgggatcaacgccagcgtggtcaacatccagaaggagatcgaccgcctgaacgaggtggccaagaacctcaacgagtccctgatcgacctgcaggagctcggcaagtacgagcagtacatcaagtggccgtggtacatctggctgggcttcatcgccgggctgatcgccatcgtgatggtcaccatcatgctctgctgcatgaccagctgctgctcctgcctgaagggctgctgcagctgcgggtcctgctgcaagttcgacgaggacgacagcgagcccgtgctgaagggcgtgaagctccactacacgtga

SEQ ID NO: 11786 - RNA, 3822 nt, synthetic construct
  misc_feature 1..3822: note = SARS-CoV-2/Greece/16/2020__EPI_ISL_418265 spike protein CDS gc (1-1273)
  source 1..3822: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacgtcgacggctacttcaagatctactccaagcacaccccgatcaacctggtgcgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtcgggtacctgcagccccgcaccttcctgctcaagtacaacgagaacggcaccatcacggacgcggtggactgcgccctggaccccctgagcgagaccaagtgcaccctcaagtccttcaccgtggagaaggggatctaccagacgagcaacttccgggtccagcccaccgagtccatcgtgcgcttcccgaacatcaccaacctgtgccccttcggcgaggtcttcaacgccacccggttcgccagcgtgtacgcctggaaccgcaagcggatctccaactgcgtggcggactacagcgtcctgtacaactccgccagcttctccacgttcaagtgctacggcgtgagccccaccaagctcaacgacctgtgcttcaccaacgtgtacgccgactccttcgtcatccgcggggacgaggtgcggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtcgtggtgctgagcttcgagctcctgcacgcccccgccacggtctgcggccccaagaagtccaccaacctggtgaagaacaagtgcgtgaacttcaacttcaacggcctcaccgggaccggcgtcctgaccgagagcaacaagaagttcctgccgttccagcagttcgggcgcgacatcgccgacacgaccgacgcggtgcgcgacccccagaccctggagatcctcgacatcaccccctgcagcttcggcggggtgtccgtcatcacgccgggcaccaacaccagcaaccaggtggccgtgctgtaccaggacgtcaactgcaccgaggtgcccgtggccatccacgccgaccagctgacgcccacctggcgggtctactccaccggcagcaacgtgttccagacccgcgccgggtgcctcatcggcgcggagcacgtgaacaactcctacgagtgcgacatccccatcggggccggcatctgcgccagctaccagacgcagaccaactccccgcggcgcgcccggagcgtcgcgtcccagagcatcatcgcctacaccatgtccctgggcgccgagaacagcgtggcctactccaacaacagcatcgccatccccaccaacttcacgatctccgtgaccaccgagatcctgcccgtcagcatgaccaagacgagcgtggactgcaccatgtacatctgcggggactccaccgagtgcagcaacctcctgctgcagtacggctccttctgcacccagctcaaccgcgcgctgacggggatcgccgtggagcaggacaagaacacccaggaggtcttcgcccaggtgaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtcctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtgacccagaacgtgctctacgagaaccagaagctgatcgccaaccagttcaacagcgccatcggcaagatccaggactccctgagctccaccgccagcgcgctcgggaagctgcaggacgtcgtgaaccagaacgcccaggccctgaacacgctcgtgaagcagctgtccagcaacttcggcgccatctccagcgtcctgaacgacatcctctcccgcctggacaaggtggaggccgaggtgcagatcgaccggctgatcaccgggcgcctccagagcctgcagacctacgtcacccagcagctgatccgggcggccgagatccgcgccagcgccaacctcgccgcgaccaagatgtccgagtgcgtgctgggccagagcaagcgggtggacttctgcggcaaggggtaccacctgatgtccttcccccagagcgccccgcacggcgtcgtgttcctccacgtcacgtacgtgcccgcccaggagaagaacttcaccaccgcccccgcgatctgccacgacgggaaggcccacttcccccgcgagggcgtgttcgtctccaacgggacccactggttcgtgacgcagcggaacttctacgagccgcagatcatcaccaccgacaacaccttcgtgagcggcaactgcgacgtcgtgatcggcatcgtgaacaacacggtctacgaccccctgcagcccgagctggactccttcaaggaggagctcgacaagtacttcaagaaccacaccagccccgacgtggacctgggggacatctccggcatcaacgccagcgtggtcaacatccagaaggagatcgaccgcctgaacgaggtggccaagaacctcaacgagtccctgatcgacctgcaggagctcgggaagtacgagcagtacatcaagtggccgtggtacatctggctgggcttcatcgccggcctgatcgcgatcgtgatggtcaccatcatgctctgctgcatgaccagctgctgctcctgcctgaaggggtgctgcagctgcggctcctgctgcaagttcgacgaggacgacagcgagcccgtgctgaagggggtgaagctccactacacgtga

SEQ ID NO: 11787 - RNA, 3822 nt, synthetic construct
  misc_feature 1..3822: note = SARS-CoV-2/Iceland/319/2020__EPI_ISL_417648 spike protein CDS gc (1-1273)
  source 1..3822: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatcgacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacaaggtcgaggccgaggtgcagatcgaccggctgatcaccggccgcctccagagcctgcagacctacgtgacccagcagctgatccgggcggccgagatccgcgccagcgccaacctcgccgcgaccaagatgtccgagtgcgtcctgggccagagcaagcgggtggacttctgcgggaagggctaccacctgatgtccttcccccagagcgccccgcacggggtggtcttcctccacgtgacgtacgtccccgcccaggagaagaacttcaccaccgcccccgcgatctgccacgacggcaaggcccacttcccccgcgagggggtgttcgtgtccaacggcacccactggttcgtcacgcagcggaacttctacgagccgcagatcatcaccaccgacaacaccttcgtgagcggcaactgcgacgtggtcatcgggatcgtgaacaacacggtgtacgaccccctgcagcccgagctggactccttcaaggaggagctcgacaagtacttcaagaaccacaccagccccgacgtcgacctgggcgacatctccgggatcaacgccagcgtggtgaacatccagaaggagatcgaccgcctgaacgaggtcgccaagaacctcaacgagtccctgatcgacctgcaggagctcggcaagtacgagcagtacatcaagtggccgtggtacatctggctgggcttcatcgccgggctgatcgcgatcgtgatggtgaccatcatgctctgctgcatgaccagctgctgctcctgcctgaagggctgctgcagctgcgggtcctgctgcaagttcgacgaggacgacagcgagcccgtcctgaagggcgtgaagctccactacacgtga

SEQ ID NO: 11788 - RNA, 3822 nt, synthetic construct
  misc_feature 1..3822: note = SARS-CoV-2/Congo/94/2020__EPI_ISL_417947 spike protein CDS gc (1-1273)
  source 1..3822: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacatcctcttcaacaaggtgaccctggccgacgccggcttcatcaagcagtacggggactgcctgggcgacatcgcggcccgcgacctcatctgcgcccagaagttcaacgggctgaccgtgctgccgcccctcctgaccgacgagatgatcgcccagtacaccagcgccctgctcgcgggcaccatcacgtccgggtggaccttcggcgccggcgccgccctgcagatccccttcgcgatgcagatggcctaccggttcaacgggatcggcgtcacccagaacgtgctgtacgagaaccagaagctcatcgccaaccagttcaacagcgccatcgggaagatccaggactccctgagctccaccgccagcgcgctgggcaagctccaggacgtggtcaaccagaacgcccaggccctgaacacgctggtgaagcagctctccagcaacttcggggccatctccagcgtgctgaacgacatcctgtcccgcctcgacaaggtcgaggccgaggtgcagatcgaccggctgatcaccggccgcctgcagagcctccagacctacgtgacccagcagctgatccgggcggccgagatccgcgccagcgccaacctggccgcgaccaagatgtccgagtgcgtcctcggccagagcaagcgggtggacttctgcgggaagggctaccacctgatgtccttcccccagagcgccccgcacggggtggtcttcctgcacgtgacgtacgtccccgcccaggagaagaacttcaccaccgcccccgcgatctgccacgacggcaaggcccacttcccccgcgagggggtgttcgtgtccaacggcacccactggttcgtcacgcagcggaacttctacgagccgcagatcatcaccaccgacaacaccttcgtgagcggcaactgcgacgtggtcatcgggatcgtgaacaacacggtgtacgaccccctccagcccgagctggactccttcaaggaggagctggacaagtacttcaagaaccacaccagccccgacgtcgacctcggcgacatctccgggatcaacgccagcgtggtgaacatccagaaggagatcgaccgcctgaacgaggtcgccaagaacctgaacgagtccctcatcgacctgcaggagctgggcaagtacgagcagtacatcaagtggccgtggtacatctggctcggcttcatcgccgggctgatcgcgatcgtgatggtgaccatcatgctgtgctgcatgaccagctgctgctcctgcctcaagggctgctgcagctgcgggtcctgctgcaagttcgacgaggacgacagcgagcccgtcctgaagggcgtgaagctgcactacacgtga

SEQ ID NO: 11789 - RNA, 3822 nt, synthetic construct
  misc_feature 1..3822: note = SARS-CoV-2/Congo/158/2020__EPI_ISL_417950 spike protein CDS gc (1-1273)
  source 1..3822: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcctgagcggcaactgcgacgtggtgatcggcatcgtcaacaacacggtgtacgaccccctgcagcccgagctcgactccttcaaggaggagctggacaagtacttcaagaaccacaccagccccgacgtggacctgggggacatctccggcatcaacgccagcgtcgtgaacatccagaaggagatcgaccgcctcaacgaggtggccaagaacctgaacgagtccctgatcgacctccaggagctggggaagtacgagcagtacatcaagtggccgtggtacatctggctgggcttcatcgccggcctcatcgcgatcgtcatggtgaccatcatgctgtgctgcatgaccagctgctgctcctgcctgaaggggtgctgcagctgcggctcctgctgcaagttcgacgaggacgacagcgagcccgtgctcaagggggtcaagctgcactacacgtga

SEQ ID NO: 11790 - RNA, 3822 nt, synthetic construct
  misc_feature 1..3822: note = SARS-CoV-2/USA/UT-00034/2020__EPI_ISL_417977 spike protein CDS gc (1-1273)
  source 1..3822: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactactacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacaaggtcgaggccgaggtgcagatcgaccggctgatcaccggccgcctccagagcctgcagacctacgtgacccagcagctgatccgggcggccgagatccgcgccagcgccaacctcgccgcgaccaagatgtccgagtgcgtcctgggccagagcaagcgggtggacttctgcgggaagggctaccacctgatgtccttcccccagagcgccccgcacggggtggtcttcctccacgtgacgtacgtccccgcccaggagaagaacttcaccaccgcccccgcgatctgccacgacggcaaggcccacttcccccgcgagggggtgttcgtgtccaacggcacccactggttcgtcacgcagcggaacttctacgagccgcagatcatcaccaccgacaacaccttcgtgagcggcaactgcgacgtggtcatcgggatcgtgaacaacacggtgtacgaccccctgcagcccgagctggactccttcaaggaggagctcgacaagtacttcaagaaccacaccagccccgacgtcgacctgggcgacatctccgggatcaacgccagcgtggtgaacatccagaaggagatcgaccgcctgaacgaggtcgccaagaacctcaacgagtccctgatcgacctgcaggagctcggcaagtacgagcagtacatcaagtggccgtggtacatctggctgggcttcatcgccgggctgatcgcgatcgtgatggtgaccatcatgctctgctgcatgaccagctgctgctcctgcctgaagggctgctgcagctgcgggtcctgctgcaagttcgacgaggacgacagcgagcccgtcctgaagggcgtgaagctccactacacgtga

SEQ ID NO: 11791 - RNA, 3822 nt, synthetic construct
  misc_feature 1..3822: note = SARS-CoV-2/USA/UT-00033/2020__EPI_ISL_417976 spike protein CDS gc (1-1273)
  source 1..3822: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggcctgaccgcgggcgccgccgcctactacgtggggtacctgcagccccgcaccttcctcctgaagtacaacgagaacggcaccatcacggacgcggtcgactgcgccctggaccccctcagcgagaccaagtgcaccctgaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctctacaactccgccagcttctccacgttcaagtgctacggcgtcagccccaccaagctgaacgacctgtgcttcaccaacgtgtacgccgactccttcgtgatccgcggggacgaggtccggcagatcgcccccggccagaccgggaagatcgccgactacaactacaagctcccggacgacttcacgggctgcgtgatcgcgtggaacagcaacaacctggactccaaggtcgggggcaactacaactacctgtaccgcctcttccgcaagagcaacctgaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctcagcttcgagctgctgcacgcccccgccacggtgtgcggccccaagaagtccaccaacctcgtcaagaacaagtgcgtgaacttcaacttcaacggcctgaccgggaccggcgtgctgaccgagagcaacaagaagttcctgccgttccagcagttcgggcgcgacatcgccgacacgaccgacgcggtccgcgacccccagaccctcgagatcctggacatcaccccctgcagcttcggcggggtgtccgtgatcacgccgggcaccaacaccagcaaccaggtcgccgtgctgtaccagggcgtgaactgcaccgaggtccccgtggccatccacgccgaccagctcacgcccacctggcgggtgtactccaccgggagcaacgtcttccagacccgcgccggctgcctgatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctccccgtgagcatgaccaagacgagcgtcgactgcaccatgtacatctgcggcgactccaccgagtgcagcaacctgctgctccagtacgggtccttctgcacccagctgaaccgcgcgctgacgggcatcgccgtggagcaggacaagaacacccaggaggtgttcgcccaggtcaagcagatctacaagacgcccccgatcaaggacttcgggggcttcaacttcagccagatcctccccgacccctccaagcccagcaagcggtccttcatcgaggacctgctgttcaacaaggtgaccctcgccgacgccggcttcatcaagcagtacggggactgcctgggcgacatcgcggcccgcgacctgatctgcgcccagaagttcaacgggctcaccgtgctgccgcccctgctcaccgacgagatgatcgcccagtacaccagcgccctgctggcgggcaccatcacgtccgggtggaccttcggcgccggcgccgccctccagatccccttcgcgatgcagatggcctaccggttcaacgggatcggcgtcacccagaacgtgctgtacgagaaccagaagctgatcgccaaccagttcaacagcgccatcgggaagatccaggactccctcagctccaccgccagcgcgctgggcaagctgcaggacgtggtcaaccagaacgcccaggccctcaacacgctggtgaagcagctgtccagcaacttcggggccatctccagcgtgctcaacgacatcctgtcccgcctggacaaggtcgaggccgaggtgcagatcgaccggctcatcaccggccgcctgcagagcctgcagacctacgtgacccagcagctcatccgggcggccgagatccgcgccagcgccaacctggccgcgaccaagatgtccgagtgcgtcctgggccagagcaagcgggtggacttctgcgggaagggctaccacctcatgtccttcccccagagcgccccgcacggggtggtcttcctgcacgtgacgtacgtccccgcccaggagaagaacttcaccaccgcccccgcgatctgccacgacggcaaggcccacttcccccgcgagggggtgttcgtgtccaacggcacccactggttcgtcacgcagcggaacttctacgagccgcagatcatcaccaccgacaacaccttcgtgagcggcaactgcgacgtggtcatcgggatcgtgaacaacacggtgtacgaccccctgcagcccgagctcgactccttcaaggaggagctggacaagtacttcaagaaccacaccagccccgacgtcgacctgggcgacatctccgggatcaacgccagcgtggtgaacatccagaaggagatcgaccgcctcaacgaggtcgccaagaacctgaacgagtccctgatcgacctccaggagctgggcaagtacgagcagtacatcaagtggccgtggtacatctggctgggcttcatcgccgggctcatcgcgatcgtgatggtgaccatcatgctgtgctgcatgaccagctgctgctcctgcctgaagggctgctgcagctgcgggtcctgctgcaagttcgacgaggacgacagcgagcccgtcctcaagggcgtgaagctgcactacacgtga

SEQ ID NO: 11792 - RNA, 3822 nt, synthetic construct
  misc_feature 1..3822: note = SARS-CoV-2/USA/WI-13/2020__EPI_ISL_417516 spike protein CDS gc (1-1273)
  source 1..3822: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgctgcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctctacaactccgccagcttctccacgttcaagtgctacggcgtcagccccaccaagctgaacgacctgtgcttcaccaacgtgtacgccgactccttcgtgatccgcggggacgaggtccggcagatcgcccccggccagaccgggaagatcgccgactacaactacaagctcccggacgacttcacgggctgcgtgatcgcgtggaacagcaacaacctggactccaaggtcgggggcaactacaactacctgtaccgcctcttccgcaagagcaacctgaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctcagcttcgagctgctgcacgcccccgccacggtgtgcggccccaagaagtccaccaacctcgtcaagaacaagtgcgtgaacttcaacttcaacggcctgaccgggaccggcgtgctgaccgagagcaacaagaagttcctgccgttccagcagttcgggcgcgacatcgccgacacgaccgacgcggtccgcgacccccagaccctcgagatcctggacatcaccccctgcagcttcggcggggtgtccgtgatcacgccgggcaccaacaccagcaaccaggtcgccgtgctgtaccagggcgtgaactgcaccgaggtccccgtggccatccacgccgaccagctcacgcccacctggcgggtgtactccaccgggagcaacgtcttccagacccgcgccggctgcctgatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctccccgtgagcatgaccaagacgagcgtcgactgcaccatgtacatctgcggcgactccaccgagtgcagcaacctgctgctccagtacgggtccttctgcacccagctgaaccgcgcgctgacgggcatcgccgtggagcaggacaagaacacccaggaggtgttcgcccaggtcaagcagatctacaagacgcccccgatcaaggacttcgggggcttcaacttcagccagatcctccccgacccctccaagcccagcaagcggtccttcatcgaggacctgctgttcaacaaggtgaccctcgccgacgccggcttcatcaagcagtacggggactgcctgggcgacatcgcggcccgcgacctgatctgcgcccagaagttcaacgggctcaccgtgctgccgcccctgctcaccgacgagatgatcgcccagtacaccagcgccctgctggcgggcaccatcacgtccgggtggaccttcggcgccggcgccgccctccagatccccttcgcgatgcagatggcctaccggttcaacgggatcggcgtcacccagaacgtgctgtacgagaaccagaagctgatcgccaaccagttcaacagcgccatcgggaagatccaggactccctcagctccaccgccagcgcgctgggcaagctgcaggacgtggtcaaccagaacgcccaggccctcaacacgctggtgaagcagctgtccagcaacttcggggccatctccagcgtgctcaacgacatcctgtcccgcctggacaaggtcgaggccgaggtgcagatcgaccggctcatcaccggccgcctgcagagcctgcagacctacgtgacccagcagctcatccgggcggccgagatccgcgccagcgccaacctggccgcgaccaagatgtccgagtgcgtcctgggccagagcaagcgggtggacttctgcgggaagggctaccacctcatgtccttcccccagagcgccccgcacggggtggtcttcctgcacgtgacgtacgtccccgcccaggagaagaacttcaccaccgcccccgcgatctgccacgacggcaaggcccacttcccccgcgagggggtgttcgtgtccaacggcacccactggttcgtcacgcagcggaacttctacgagccgcagatcatcaccaccgacaacaccttcgtgagcggcaactgcgacgtggtcatcgggatcgtgaacaacacggtgtacgaccccctgcagcccgagctcgactccttcaaggaggagctggacaagtacttcaagaaccacaccagccccgacgtcgacctgggcgacatctccgggatcaacgccagcgtggtgaacatccagaaggagatcgaccgcctcaacgaggtcgccaagaacctgaacgagtccctgatcgacctccaggagctgggcaagtacgagcagtacatcaagtggccgtggtacatctggctgggcttcatcgccgggctcatcgcgatcgtgatggtgaccatcatgctgtgctgcatgaccagctgctgctcctgcctgaagggctgctgcagctgcgggtcctgctgcaagttcgacgaggacgacagcgagcccgtcctcaagggcgtgaagctgcactacacgtga

SEQ ID NO: 11793 - RNA, 3819 nt, synthetic construct
  misc_feature 1..3819: note = SARS-CoV-2/India/1-27/2020__EPI_ISL_413522 spike protein CDS gc (1-1272)
  source 1..3819: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtcatccagatcgcccccggccagaccgggaagatcgccgactacaactacaagctgccggacgacttcacgggctgcgtgatcgcgtggaacagcaacaacctcgactccaaggtcgggggcaactacaactacctgtaccggctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgcgtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgggacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgcgtgtactccaccggcagcaacgtcttccagacccgggccgggtgcctcatcggcgcggagcacgtgaacaactcctacgagtgcgacatccccatcggggccggcatctgcgccagctaccagacgcagaccaactccccgcgccgggcccgcagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgggcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcgctccttcatcgaggacctcctgttcaacaaggtgaccctggccgacgccggcttcatcaagcagtacggcgactgcctcggggacatcgcggcccgggacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccgcttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccggctggacaaggtcgaggccgaggtgcagatcgaccgcctgatcaccgggcggctccagagcctgcagacctacgtgacccagcagctgatccgcgcggccgagatccgggccagcgccaacctcgccgcgaccaagatgtccgagtgcgtcctgggccagagcaagcgcgtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgggagggcgtgttcgtgtccaacgggacccactggttcgtcacgcagcgcaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccggctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtga

SEQ ID NO: 11794 - RNA, 3804 nt, synthetic construct
  misc_feature 1..3804: note = SARS-CoV-2/pangolin/Guangxi/P4L/2017__EPI_ISL_410538 spike protein CDS gc (1-1267)
  source 1..3804: mol_type = other RNA
atgttcgtgttcctgttcgtcctccccctggtgagctcccagtgcgtgaacctgaccacccgcacgggcatcccgcccgggtacaccaacagctccacccggggcgtctactaccccgacaaggtgttccgcagctccatcctccacctgacccaggacctgttcctccccttcttcagcaacgtgacgtggttcaacaccatcaactaccagggcgggttcaagaagttcgacaacccggtcctgcccttcaacgacggggtgtacttcgcctccaccgagaagtccaacatcatccggggctggatcttcggcaccacgctggacgcccgcacccagagcctcctgatcgtgaacaacgcgaccaacgtcgtgatcaaggtgtgcgagttccagttctgcaccgaccccttcctgggggtctactaccacaacaacaacaagacgtgggtggagaacgagttccgggtgtacagctccgccaacaactgcaccttcgagtacatcagccagcccttcctcatggacctggagggcaagcaggggaacttcaagaacctgcgcgagttcgtcttcaagaacgtggacggctacttcaagatctactccaagcacaccccgatcgacctcgtgcgggacctgccccgcgggttcgccgccctggagcccctcgtcgacctgcccatcggcatcaacatcacccggttccagacgctgctcgccctgcaccgcagctacctgaccccgggcaacctcgagtccgggtggaccaccggcgcggccgcctactacgtggggtacctgcagcagcggacgttcctgctcagctacaaccagaacggcaccatcaccgacgccgtggactgctccctggaccccctgagcgagaccaagtgcacgctcaagtccctgaccgtcgagaagggcatctaccagaccagcaacttccgcgtgcagcccaccatcagcatcgtgcggttccccaacatcacgaacctgtgcccgttcggggaggtcttcaacgcgtccaagttcgccagcgtgtacgcctggaaccgcaagcggatctccaactgcgtcgccgactacagcgtgctctacaactccaccagcttctccaccttcaagtgctacggcgtgagccccaccaagctgaacgacctgtgcttcacgaacgtctacgccgactccttcgtggtgaagggggacgaggtccgccagatcgcgcccggccagaccggggtgatcgccgactacaactacaagctccccgacgacttcaccggctgcgtgatcgcctggaacagcgtcaagcaggacgccctgaccggcgggaactacggctacctgtaccgcctcttccggaagtccaagctgaagccgttcgagcgggacatcagcacggagatctaccaggccgggtccaccccctgcaacggccaggtggggctgaactgctactaccccctcgagcgctacggcttccaccccaccaccggcgtgaactaccagccgttccgggtcgtggtgctgagcttcgagctgctcaacgggcccgcgaccgtctgcggccccaagctgtccacgaccctggtgaaggacaagtgcgtgaacttcaacttcaacgggctgaccggcaccggggtcctcacgaccagcaagaagcagttcctgcccttccagcagttcggccgcgacatctccgacaccaccgacgccgtgcgcgacccgcagacgctggagatcctcgacatcaccccctgcagcttcggcggggtgtccgtcatcacccccggcaccaacacgagcaaccaggtggccgtgctgtaccaggacgtcaactgcaccgaggtgccgatggccatccacgccgagcagctgacccccgcgtggcgggtgtacagcgccggggccaacgtcttccagacccgcgccggctgcctcgtgggcgccgagcacgtgaacaactcctacgagtgcgacatccccgtcggggcgggcatctgcgccagctaccactccatgagctccctgcggagcgtgaaccagcgctccatcatcgcctacacgatgagcctgggggccgagaactccgtggcgtacagcaacaactccatcgccatccccaccaacttcaccatcagcgtcaccacggagatcctcccggtgtccatgaccaagaccagcgtggactgcaccatgtacatctgcggcgactccatcgagtgcagcaacctgctgctccagtacgggtccttctgcacgcagctgaaccgggccctgaccggcatcgccgtcgagcaggacaagaacacccaggaggtgttcgcccaggtgaagcagatctacaagaccccgcccatcaaggacttcggcgggttcaacttcagccagatcctccccgaccccagcaagccctccaagcgcagcttcatcgaggacctgctgttcaacaaggtcacgctcgcggacgccggcttcatcaagcagtacggggactgcctgggcgacatcgccgcccgggacctgatctgcgcccagaagttcaacgggctcaccgtgctgccgcccctgctcaccgacgagatgatcgcgcagtacacctccgccctgctggccggcacgatcaccagcggctggaccttcggggccggcgccgcgctccagatccccttcgccatgcagatggcctaccgcttcaacgggatcggcgtgacccagaacgtcctgtacgagaaccagaagctgatcgccaaccagttcaactccgcgatcgggaagatccaggacagcctctccagcacggcctccgccctgggcaagctgcaggacgtggtgaaccagaacgcccaggccctcaacaccctggtcaagcagctgagctccaacttcggcgcgatcagctccgtgctcaacgacatcctgagccggctggacaaggtggaggccgaggtccagatcgaccgcctcatcaccgggcggctgcagtccctgcagacctacgtgacccagcagctcatccgcgccgccgagatccgggccagcgcgaacctggccgccacgaagatgtccgagtgcgtgctgggccagagcaagcgcgtcgacttctgcgggaagggctaccacctcatgtccttcccccagagcgcgccccacggggtggtcttcctgcacgtgacctacgtgcccgcccaggagaagaacttcaccaccgccccggccatctgccacgagggcaaggcccacttcccccgggagggcgtcttcgtgagcaacgggacgcactggttcatcacccagcgcaacttctacgagccccagatcatcaccaccgacaacacgttcgtgtccggcagctgcgacgtcgtgatcgggatcgtgaacaacaccgtctacgaccccctgcagccggagctcgactccttcaaggaggagctggacaagtacttcaagaaccacaccagccccgacgtggacctgggcgacatctccggcatcaacgccagcgtggtcaacatccagaaggagatcgaccggctcaacgaggtggcgaagaacctgaacgagtcccccatcgacctgcaggagctcgggaagtacgagcagtacatcaagtggccctggtacatctggctgggcttcatcgccgggctgatcgccatcatcatggtgaccatcatgctctgctgcatgacgagctgctgctcctgcctgaagggctgctgcagctgcgggtcctgctgcaagttcgacgaggacgacagcgagccggtcctgaagggcgtgaagctccactacacctga

SEQ ID NO: 11795 - RNA, 3804 nt, synthetic construct
  misc_feature 1..3804: note = SARS-CoV-2/pangolin/Guangxi/P5L/2017__EPI_ISL_410540 spike protein CDS gc (1-1267)
  source 1..3804: mol_type = other RNA
atgttcgtgttcctgttcgtcctccccctggtgagctcccagtgcgtgaacctgaccacccgcacgggcatcccgcccgggtacaccaacagctccacccggggcgtctactaccccgacaaggtgttccgcagctccatcctccacctgacccaggacctgttcctccccttcttcagcaacgtgacgtggttcaacaccatcaactaccagggcgggttcaagaagttcgacaacccggtcctgcccttcaacgacggggtgtacttcgcctccaccgagaagtccaacatcatccggggctggatcttcggcaccacgctggacgcccgcacccagagcctcctgatcgtgaacaacgcgaccaacgtcgtgatcaaggtgtgcgagttccagttctgcaccgaccccttcctgggggtctactaccacaacaacaacaagacgtgggtggagaacgagttccgggtgtacagctccgccaacaactgcaccttcgagtacatcagccagcccttcctcatggacctggagggcaagcaggggaacttcaagaacctgcgcgagttcgtcttcaagaacgtggacggctacttcaagatctactccaagcacaccccgatcgacctcgtgcgggacctgccccgcgggttcgccgccctggagcccctcgtcgacctgcccatcggcatcaacatcacccggttccagacgctgctcgccctgcaccgcagctacctgaccccgggcaagctcgagtccgggtggaccaccggcgcggccgcctactacgtggggtacctgcagcagcggacgttcctgctcagctacaaccagaacggcaccatcaccgacgccgtggactgctccctggaccccctgagcgagaccaagtgcacgctcaagtccctgaccgtcgagaagggcatctaccagaccagcaacttccgcgtgcagcccaccatcagcatcgtgcggttccccaacatcacgaacctgtgcccgttcggggaggtcttcaacgcgtccaagttcgccagcgtgtacgcctggaaccgcaagcggatctccaactgcgtcgccgactacagcgtgctctacaactccaccagcttctccaccttcaagtgctacggcgtgagccccaccaagctgaacgacctgtgcttcacgaacgtctacgccgactccttcgtggtgaagggggacgaggtccgccagatcgcgcccggccagaccggggtgatcgccgactacaactacaagctccccgacgacttcaccggctgcgtgatcgcctggaacagcgtcaagcaggacgccctgaccggcgggaactacggctacctgtaccgcctcttccggaagtccaagctgaagccgttcgagcgggacatcagcacggagatctaccaggccgggtccaccccctgcaacggccaggtggggctgaactgctactaccccctcgagcgctacggcttccaccccaccaccggcgtgaactaccagccgttccgggtcgtggtgctgagcttcgagctgctcaacgggcccgcgaccgtctgcggccccaagctgtccacgaccctggtgaaggacaagtgcgtgaacttcaacttcaacgggctgaccggcaccggggtcctcacgaccagcaagaagcagttcctgcccttccagcagttcggccgcgacatctccgacaccaccgacgccgtgcgcgacccgcagacgctggagatcctcgacatcaccccctgcagcttcggcggggtgtccgtcatcacccccggcaccaacacgagcaaccaggtggccgtgctgtaccaggacgtcaactgcaccgaggtgccgatggccatccacgccgagcagctgacccccgcgtggcgggtgtacagcgccggggccaacgtcttccagacccgcgccggctgcctcgtgggcgccgagcacgtgaacaactcctacgagtgcgacatccccgtcggggcgggcatctgcgccagctaccactccatgagctccttccggagcgtgaaccagcgctccatcatcgcctacacgatgagcctgggggccgagaactccgtggcgtacagcaacaactccatcgccatccccaccaacttcaccatcagcgtcaccacggagatcctgccggtgtccatgaccaagaccagcgtggactgcaccatgtacatctgcggcgactccatcgagtgcagcaacctcctgctgcagtacgggtccttctgcacgcagctcaaccgggccctgaccggcatcgccgtcgagcaggacaagaacacccaggaggtgttcgcccaggtgaagcagatctacaagaccccgcccatcaaggacttcggcgggttcaacttcagccagatcctgcccgaccccagcaagccctccaagcgcagcttcatcgaggacctcctgttcaacaaggtcacgctggcggacgccggcttcatcaagcagtacggggactgcctcggcgacatcgccgcccgggacctgatctgcgcccagaagttcaacgggctgaccgtgctcccgcccctgctgaccgacgagatgatcgcgcagtacacctccgccctcctggccggcacgatcaccagcggctggaccttcggggccggcgccgcgctgcagatccccttcgccatgcagatggcctaccgcttcaacgggatcggcgtgacccagaacgtcctctacgagaaccagaagctgatcgccaaccagttcaactccgcgatcgggaagatccaggacagcctgtccagcacggcctccgccctcggcaagctgcaggacgtggtgaaccagaacgcccaggccctgaacaccctcgtcaagcagctgagctccaacttcggcgcgatcagctccgtgctgaacgacatcctcagccggctggacaaggtggaggccgaggtccagatcgaccgcctgatcaccgggcggctccagtccctgcagacctacgtgacccagcagctgatccgcgccgccgagatccgggccagcgcgaacctcgccgccacgaagatgtccgagtgcgtgctgggccagagcaagcgcgtcgacttctgcgggaagggctaccacctgatgtccttcccccagagcgcgccccacggggtggtcttcctccacgtgacctacgtgcccgcccaggagaagaacttcaccaccgccccggccatctgccacgagggcaaggcccacttcccccgggagggcgtcttcgtgagcaacgggacgcactggttcatcacccagcgcaacttctacgagccccagatcatcaccaccgacaacacgttcgtgtccggcagctgcgacgtcgtgatcgggatcgtgaacaacaccgtctacgaccccctgcagccggagctggactccttcaaggaggagctcgacaagtacttcaagaaccacaccagccccgacgtggacctgggcgacatctccggcatcaacgccagcgtggtcaacatccagaaggagatcgaccggctgaacgaggtggcgaagaacctcaacgagtccctgatcgacctgcaggagctcgggaagtacgagcagtacatcaagtggccctggtacatctggctgggcttcatcgccgggctgatcgccatcatcatggtgaccatcatgctctgctgcatgacgagctgctgctcctgcctgaagggctgctgcagctgcgggtcctgctgcaagttcgacgaggacgacagcgagcccgtcctgaagggcgtgaagctccactacacctga

SEQ ID NO: 11796 - RNA, 3804 nt, synthetic construct
  misc_feature 1..3804: note = SARS-CoV-2/pangolin/Guangxi/P5E/2017__EPI_ISL_410541 spike protein CDS gc (1-1267)
  source 1..3804: mol_type = other RNA
atgttcgtgttcctgttcgtcctccccctggtgagctcccagtgcgtgaacctgaccacccgcacgggcatcccgcccgggtacaccaacagctccacccggggcgtctactaccccgacaaggtgttccgcagctccatcctccacctgacccaggacctgttcctccccttcttcagcaacgtgacgtggttcaacaccatcacctaccagggcgggtccaagaagttcgacaacccggtcctgcccttcaacgacggggtgtacttcgccagcaccgagaagtccaacatcatccggggctggatcttcggcacgaccctggacgcccgcacccagagcctcctgatcgtgaacaacgcgaccaacgtcgtgatcaaggtgtgcgagttccagttctgcacggaccccttcctgggggtctactaccacaacaacaacaagacctgggtggagaacgagttccgggtgtactccagcgccaacaactgcaccttcgagtacatctcccagcccttcctcatggacctggagggcaagcaggggaacttcaagaacctgcgcgagttcgtcttcaagaacgtggacggctacttcaagatctacagcaagcacaccccgatcgacctcgtgcgggacctgccccgcgggttcgccgccctggagcccctcgtcgacctgcccatcggcatcaacatcacgcggttccagaccctgctcgccctgcaccgctcctacctgaccccgggcaagctcgagagcgggtggaccacgggcgcggccgcctactacgtggggtacctgcagcagcggaccttcctgctctcctacaaccagaacggcaccatcaccgacgccgtggactgcagcctggaccccctgtccgagacgaagtgcaccctcaagagcctgaccgtcgagaagggcatctaccagaccagcaacttccgcgtgcagcccacgatctccatcgtgcggttccccaacatcaccaacctgtgcccgttcggggaggtcttcaacgcgagcaagttcgcctccgtgtacgcctggaaccgcaagcggatcagcaactgcgtcgccgactactccgtgctctacaacagcacctccttcagcaccttcaagtgctacggcgtgtcccccacgaagctgaacgacctgtgcttcaccaacgtctacgccgacagcttcgtggtgaagggggacgaggtccgccagatcgcgcccggccagaccggggtgatcgccgactacaactacaagctccccgacgacttcaccggctgcgtgatcgcctggaactccgtcaagcaggacgccctgacgggcgacaactacgggtacctgtaccggctgttccgcaagagcaagctcaagccgttcgagcgggacatctccaccgagatctaccaggccggcagcaccccctgcaacggccaggtggggctgaactgctactaccccctcgagcgctacgggttccaccccaccaccggcgtgaactaccagccgttccgggtcgtggtgctgtccttcgagctgctcaacggccccgcgacggtctgcgggcccaagctgagcaccaccctggtgaaggacaagtgcgtgaacttcaacttcaacggcctgaccgggacgggcgtcctcaccacctccaagaagcagttcctgcccttccagcagttcgggcgcgacatcagcgacaccacggacgccgtgcgcgacccgcagaccctggagatcctcgacatcaccccctgctccttcggcggcgtgagcgtcatcacccccgggacgaacaccagcaaccaggtggccgtgctgtaccaggacgtcaactgcaccgaggtgccgatggccatccacgccgagcagctgacccccgcgtggcgggtgtactccgccggcgccaacgtcttccagacgcgcgccgggtgcctcgtgggcgccgagcacgtgaacaacagctacgagtgcgacatccccgtcggcgcggggatctgcgcctcctaccacagcatgtccagcttccggtccgtgaaccagcgcagcatcatcgcctacaccatgtccctgggcgccgagaacagcgtggcgtactccaacaacagcatcgccatccccaccaacttcaccatctccgtcacgaccgagatcctgccggtgagcatgaccaagacctccgtggactgcacgatgtacatctgcggggacagcatcgagtgctccaacctcctgctgcagtacggcagcttctgcacccagctcaaccgggccctgaccgggatcgccgtcgagcaggacaagaacacccaggaggtgttcgcccaggtgaagcagatctacaagacgccgcccatcaaggacttcggcggcttcaacttcagccagatcctgcccgacccctccaagcccagcaagcgctccttcatcgaggacctcctgttcaacaaggtcaccctggcggacgccgggttcatcaagcagtacggcgactgcctcggggacatcgccgcccgggacctgatctgcgcccagaagttcaacggcctgaccgtgctcccgcccctgctgaccgacgagatgatcgcgcagtacacgagcgccctcctggccgggaccatcacctccggctggaccttcggcgccggggccgcgctgcagatccccttcgccatgcagatggcctaccgcttcaacggcatcggggtgacgcagaacgtcctctacgagaaccagaagctgatcgccaaccagttcaacagcgcgatcggcaagatccaggactccctgagctccaccgccagcgccctcgggaagctgcaggacgtggtgaaccagaacgcccaggccctgaacaccctcgtcaagcagctgtccagcaacttcggcgcgatctccagcgtgctgaacgacatcctctcccggctggacaaggtggaggccgaggtccagatcgaccgcctgatcaccggccggctccagagcctgcagacctacgtgacgcagcagctgatccgcgccgccgagatccgggcctccgcgaacctcgccgccaccaagatgagcgagtgcgtgctggggcagtccaagcgcgtcgacttctgcggcaaggggtaccacctgatgagcttcccccagagcgcgccccacggcgtggtcttcctccacgtgacctacgtgcccgcccaggagaagaacttcaccacggccccggccatctgccacgaggggaaggcccacttcccccgggagggcgtcttcgtgtccaacggcacccactggttcatcacccagcgcaacttctacgagccccagatcatcaccacggacaacaccttcgtgagcgggtcctgcgacgtcgtgatcggcatcgtgaacaacaccgtctacgaccccctgcagccggagctggacagcttcaaggaggagctcgacaagtacttcaagaaccacacctcccccgacgtggacctgggggacatcagcggcatcaacgcctccgtggtcaacatccagaaggagatcgaccggctgaacgaggtggcgaagaacctcaacgagagcctgatcgacctgcaggagctcggcaagtacgagcagtacatcaagtggccctggtacatctggctggggttcatcgccggcctgatcgccatcatcatggtgacgatcatgctctgctgcatgacctcctgctgcagctgcctgaaggggtgctgctcctgcggcagctgctgcaagttcgacgaggacgactccgagcccgtcctgaagggggtgaagctccactacacctga

SEQ ID NO: 11797 - RNA, 3798 nt, synthetic construct
  misc_feature 1..3798: note = SARS-CoV-2/pangolin/Guangxi/P1E/2017__EPI_ISL_410539 spike protein CDS gc (1-1265)
  source 1..3798: mol_type = other RNA
atgttcgtgttcctgttcgtcctccccctggtgagctcccagtgcgtgaacctgaccacccgcacgggcatccagccggggtacaccaacagctccacccggggcgtctactaccccgacaaggtgttccgcagctccatcctccacctgacccaggacctgttcctccccttcttcagcaacgtgacgtggttcaacaccatcaactaccagggcgggttcaagaagttcgacaaccccgtcctgccgttcaacgacggggtgtacttcgcctccaccgagaagtccaacatcatccggggctggatcttcggcaccacgctggacgcccgcacccagagcctcctgatcgtgaacaacgcgaccaacgtcgtgatcaaggtgtgcgagttccagttctgcaccgaccccttcctgggggtctactaccacaacaacaacaagacgtgggtggagaacgagttccgggtgtacagctccgccaacaactgcaccttcgagtacatcagccagcccttcctcatggacctggagggcaagcaggggaacttcaagaacctgcgcgagttcgtcttcaagaacgtggacggctacttcaagatctactccaagcacacccccatcgacctcgtgcgggacctgccgcgcgggttcgccgccctggagcccctcgtcgacctgcccatcggcatcaacatcacccggttccagacgctgctcgccctgcaccgcagctacctgacccccggcaagctcgagtccgggtggaccaccggcgcggccgcctactacgtggggtacctgcagcagcggacgttcctgctcagctacaaccagaacggcaccatcaccgacgccgtggactgctccctggacccgctgagcgagaccaagtgcacgctcaagtccctgaccgtcgagaagggcatctaccagaccagcaacttccgcgtgcagcccaccatcagcatcgtgcggttccccaacatcacgaacctgtgccccttcggggaggtcttcaacgcgtccaagttcgccagcgtgtacgcctggaaccgcaagcggatctccaactgcgtcgccgactacagcgtgctctacaactccaccagcttctccaccttcaagtgctacggcgtgagcccgaccaagctgaacgacctgtgcttcacgaacgtctacgccgactccttcgtggtgaagggggacgaggtccgccagatcgcgcccggccagaccggggtgatcgccgactacaactacaagctccccgacgacttcaccggctgcgtgatcgcctggaacagcgtcaagcaggacgccctgaccggcgggaactacctgtaccgcctcttccggaagtccaagctgaagcccttcgagcgggacatcagcacggagatctaccaggccggctccaccccgtgcaacggccaggtggggctgaactgctactaccccctcgagcgctacgggttccaccccaccaccggcgtgaactaccagcccttccgggtcgtggtgctgagcttcgagctgctcaacggcccggcgaccgtctgcgggcccaagctgtccacgaccctggtgaaggacaagtgcgtgaacttcaacttcaacggcctgaccgggaccggcgtcctcacgaccagcaagaagcagttcctgcccttccagcagttcgggcgcgacatctccgacaccaccgacgccgtgcgcgacccccagacgctggagatcctcgacatcaccccgtgcagcttcggcggcgtgtccgtcatcacccccgggaccaacacgagcaaccaggtggccgtgctgtaccaggacgtcaactgcaccgaggtgcccatggccatccacgccgagcagctgaccccggcgtggcgggtgtacagcgccggcgccaacgtcttccagacccgcgccgggtgcctcgtgggcgccgagcacgtgaacaactcctacgagtgcgacatccccgtcggcgcggggatctgcgccagctaccactccatgagctccctgcggagcgtgaaccagcgctccatcatcgcctacacgatgagcctgggcgccgagaactccgtggcgtacagcaacaactccatcgccatccccaccaacttcaccatcagcgtcaccacggagatcctccccgtgtccatgaccaagaccagcgtggactgcaccatgtacatctgcggggactccatcgagtgcagcaacctgctgctccagtacggctccttctgcacgcagctgaaccgggccctgaccgggatcgccgtcgagcaggacaagaacacccaggaggtgttcgcccaggtgaagcagatctacaagaccccgcccatcaaggacttcggcggcttcaacttcagccagatcctccccgaccccagcaagccgtccaagcgcagcttcatcgaggacctgctgttcaacaaggtcacgctcgcggacgccgggttcatcaagcagtacggcgactgcctgggggacatcgccgcccgggacctgatctgcgcccagaagttcaacggcctcaccgtgctgccgcccctgctcaccgacgagatgatcgcgcagtacacctccgccctgctggccgggacgatcaccagcggctggaccttcggcgccggggccgcgctccagatccccttcgccatgcagatggcctaccgcttcaacggcatcggggtgacccagaacgtcctgtacgagaaccagaagctgatcgccaaccagttcaactccgcgatcggcaagatccaggacagcctctccagcacggcctccgccctggggaagctgcaggacgtggtgaaccagaacgcccaggccctcaacaccctggtcaagcagctgagctccaacttcggcgcgatcagctccgtgctcaacgacatcctgagccggctggacaaggtggaggccgaggtccagatcgaccgcctcatcaccggccggctgcagtccctgcagacctacgtgacccagcagctcatccgcgccgccgagatccgggccagcgcgaacctggccgccacgaagatgtccgagtgcgtgctggggcagagcaagcgcgtcgacttctgcggcaaggggtaccacctcatgtccttcccccagagcgcgccccacggcgtggtcttcctgcacgtgacctacgtgcccgcccaggagaagaacttcaccaccgcccccgccatctgccacgaggggaaggcccacttcccgcgggagggcgtcttcgtgagcaacggcacgcactggttcatcacccagcgcaacttctacgagccccagatcatcaccaccgacaacacgttcgtgtccgggagctgcgacgtcgtgatcggcatcgtgaacaacaccgtctacgaccccctgcagcccgagctcgactccttcaaggaggagctggacaagtacttcaagaaccacaccagcccggacgtggacctgggggacatctccggcatcaacgccagcgtggtcaacatccagaaggagatcgaccggctcaacgaggtggcgaagaacctgaacgagtccctgatcgacctccaggagctgggcaagtacgagcagtacatcaagtggccctggtacatctggctggggttcatcgccggcctcatcgccatcatcatggtgaccatcatgctgtgctgcatgacgagctgctgctcctgcctgaaggggtgctgcagctgcggctcctgctgcaagttcgacgaggacgacagcgagcccgtcctcaagggggtgaagctgcactacacctga

SEQ ID NO: 11798 - RNA, 3822 nt, synthetic construct; identical to SEQ ID NO: 137
  misc_feature 1..3822: note = SARS-CoV-2/Wuhan/WIV05/2019__EPI_ISL_402128 spike protein CDS gc (1-1273)(K986P_V987P)
  source 1..3822: mol_type = other RNA

SEQ ID NO: 11799 - RNA, 3822 nt, synthetic construct
  misc_feature 1..3822: note = SARS-CoV-2/Wuhan/WIV05/2019__EPI_ISL_402128 spike protein CDS gc (1-1273)(K986P_V987P_T887WN_A1020W)
  source 1..3822: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggtggttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgctggagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtga

SEQ ID NO: 11800 - RNA, 3822 nt, synthetic construct
  misc_feature 1..3822: note = SARS-CoV-2/Wuhan/WIV05/2019__EPI_ISL_402128 spike protein CDS gc (1-1273)(K986P_V987P_P1069F)
  source 1..3822: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtcttcgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtga

SEQ ID NO: 11801 - RNA, 3822 nt, synthetic construct
  misc_feature 1..3822: note = SARS-CoV-2/Wuhan/WIV05/2019__EPI_ISL_402128 spike protein CDS gc (1-1273)(K986P_V987P_ H1048Q_H1064N_ H1083N_H1101N)
  source 1..3822: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccagctgatgtccttcccccagagcgccccgcacggcgtggtcttcctcaacgtgacgtacgtccccgcccaggagaagaacttcaccaccgcccccgcgatctgcaacgacgggaaggcccacttcccccgcgagggcgtgttcgtgtccaacgggaccaactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtga

SEQ ID NO: 11802 - RNA, 3822 nt, synthetic construct
  misc_feature 1..3822: note = SARS-CoV-2/Wuhan/WIV05/2019__EPI_ISL_402128 spike protein CDS gc (1-1273)(I712C_T1077C)
  source 1..3822: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagctgcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcacctgcgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtga

SEQ ID NO: 11803 - RNA, 3822 nt, synthetic construct
  misc_feature 1..3822: note = SARS-CoV-2/Wuhan/WIV05/2019__EPI_ISL_402128 spike protein CDS gc (1-1273)(I714C_Y1110C)
  source 1..3822: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgcctgccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctgcgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtga

SEQ ID NO: 11804 - RNA, 3822 nt, synthetic construct
  misc_feature 1..3822: note = SARS-CoV-2/Wuhan/WIV05/2019__EPI_ISL_402128 spike protein CDS gc (1-1273)(P715C_P1069C)
  source 1..3822: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatctgcaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtctgcgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtga

SEQ ID NO: 11805 - RNA, 3822 nt, synthetic construct
  misc_feature 1..3822: note = SARS-CoV-2/Wuhan/WIV05/2019__EPI_ISL_402128 spike protein CDS gc (1-1273)(G889C_L1034C)
  source 1..3822: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttctgcgccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtctgcggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtga

SEQ ID NO: 11806 - RNA, 3822 nt, synthetic construct
  misc_feature 1..3822: note = SARS-CoV-2/Wuhan/WIV05/2019__EPI_ISL_402128 spike protein CDS gc (1-1273)(I909C_Y1047C)
  source 1..3822: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggctgcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtgccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtga

SEQ ID NO: 11807 - RNA, 3822 nt, synthetic construct
  misc_feature 1..3822: note = SARS-CoV-2/Wuhan/WIV05/2019__EPI_ISL_402128 spike protein CDS gc (1-1273)(Q965C_S1003C)
  source 1..3822: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagtgcctgtccagcaacttcggcgccatctccagcgtgctgaacgacatcctctcccgcctggacaaggtcgaggccgaggtgcagatcgaccggctgatcaccgggcgcctccagtgcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtga

SEQ ID NO: 11808 - RNA, 3822 nt, synthetic construct
  misc_feature 1..3822: note = SARS-CoV-2/Wuhan/WIV05/2019__EPI_ISL_402128 spike protein CDS gc (1-1273)(F970C_G999C)
  source 1..3822: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaactgcggcgccatctccagcgtgctgaacgacatcctctcccgcctggacaaggtcgaggccgaggtgcagatcgaccggctgatcacctgtcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtga

SEQ ID NO: 11809 - RNA, 3822 nt, synthetic construct
  misc_feature 1..3822: note = SARS-CoV-2/Wuhan/WIV05/2019__EPI_ISL_402128 spike protein CDS gc (1-1273)(A972C_R995C)
  source 1..3822: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggctgcatctccagcgtgctgaacgacatcctctcccgcctggacaaggtcgaggccgaggtgcagatcgactgcctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtga

SEQ ID NO: 11810 - RNA, 3822 nt, synthetic construct
  misc_feature 1..3822: note = SARS-CoV-2/Wuhan/WIV05/2019__EPI_ISL_402128 spike protein CDS gc (1-1273)(A890C_V1040C)
  source 1..3822: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcgggtgcggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcggtgcgacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtga

SEQ ID NO: 11811 - RNA, 3822 nt, synthetic construct
  misc_feature 1..3822: note = SARS-CoV-2/Wuhan/WIV05/2019__EPI_ISL_402128 spike protein CDS gc (1-1273)(T874C_S1055C)
  source 1..3822: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtactgcagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagtgcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtga

SEQ ID NO: 11812 - RNA, 2046 nt, synthetic construct; identical to SEQ ID NO: 138
  misc_feature 1..2046: note = SARS-CoV-2/Wuhan/WIV05/2019__EPI_ISL_402128 spike protein CDS gc (1-681)
  source 1..2046: mol_type = other RNA

SEQ ID NO: 11813 - RNA, 1776 nt, synthetic construct; identical to SEQ ID NO: 141
  misc_feature 1..1776: note = SARS-CoV-2/Wuhan/WIV05/2019__EPI_ISL_402128 spike protein CDS gc (682-1273)
  source 1..1776: mol_type = other RNA

SEQ ID NO: 11814 - RNA, 45 nt, synthetic construct; identical to SEQ ID NO: 139
  misc_feature 1..45: note = SARS-CoV-2/Wuhan/WIV05/2019__EPI_ISL_402128 spike protein CDS gc (1-15)
  source 1..45: mol_type = other RNA

SEQ ID NO: 11815 - RNA, 1998 nt, synthetic construct; identical to SEQ ID NO: 140
  misc_feature 1..1998: note = SARS-CoV-2/Wuhan/WIV05/2019__EPI_ISL_402128 spike protein CDS gc (16-681)
  source 1..1998: mol_type = other RNA

SEQ ID NO: 11816 - RNA, 189 nt, synthetic construct
  misc_feature 1..189: note = SARS-CoV-2/Wuhan/WIV05/2019__EPI_ISL_402128 spike protein CDS gc (1212-1273)
  source 1..189: mol_type = other RNA
tggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtga

SEQ ID NO: 11817 - RNA, 3633 nt, synthetic construct
  misc_feature 1..3633: note = SARS-CoV-2/Wuhan/WIV05/2019__EPI_ISL_402128 spike protein CDS gc (1-1211)
  source 1..3633: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaag

SEQ ID NO: 11818 - RNA, 3633 nt, synthetic construct
  misc_feature 1..3633: note = SARS-CoV-2/Wuhan/WIV05/2019__EPI_ISL_402128 spike protein CDS gc (1-1211)(K986P_V987P)
  source 1..3633: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaag

SEQ ID NO: 11819 - RNA, 3633 nt, synthetic construct
  misc_feature 1..3633: note = SARS-CoV-2/Wuhan/WIV05/2019__EPI_ISL_402128 spike protein CDS gc (1-1211)(K986P_V987P_T887WN_A1020W)
  source 1..3633: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggtggttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgctggagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaag

SEQ ID NO: 11820 - RNA, 3633 nt, synthetic construct
  misc_feature 1..3633: note = SARS-CoV-2/Wuhan/WIV05/2019__EPI_ISL_402128 spike protein CDS gc (1-1211)(K986P_V987P_P1069F)
  source 1..3633: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtcttcgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaag

SEQ ID NO: 11821 - RNA, 3633 nt, synthetic construct
  misc_feature 1..3633: note = SARS-CoV-2/Wuhan/WIV05/2019__EPI_ISL_402128 spike protein CDS gc (1-1211)(K986P_V987P_ H1048Q_H1064N_ H1083N_H1101N)
  source 1..3633: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccagctgatgtccttcccccagagcgccccgcacggcgtggtcttcctcaacgtgacgtacgtccccgcccaggagaagaacttcaccaccgcccccgcgatctgcaacgacgggaaggcccacttcccccgcgagggcgtgttcgtgtccaacgggaccaactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaag

SEQ ID NO: 11822 - RNA, 3633 nt, synthetic construct
  misc_feature 1..3633: note = SARS-CoV-2/Wuhan/WIV05/2019__EPI_ISL_402128 spike protein CDS gc (1-1211)(I712C_T1077C)
  source 1..3633: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagctgcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcacctgcgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaag

SEQ ID NO: 11823 - RNA, 3633 nt, synthetic construct
  misc_feature 1..3633: note = SARS-CoV-2/Wuhan/WIV05/2019__EPI_ISL_402128 spike protein CDS gc (1-1211)(I714C_Y1110C)
  source 1..3633: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgcctgccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctgcgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaag

SEQ ID NO: 11824 - RNA, 3633 nt, synthetic construct
  misc_feature 1..3633: note = SARS-CoV-2/Wuhan/WIV05/2019__EPI_ISL_402128 spike protein CDS gc (1-1211)(P715C_P1069C)
  source 1..3633: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatctgcaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtctgcgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaag

SEQ ID NO: 11825 - RNA, 3633 nt, synthetic construct
  misc_feature 1..3633: note = SARS-CoV-2/Wuhan/WIV05/2019__EPI_ISL_402128 spike protein CDS gc (1-1211)(G889C_L1034C)
  source 1..3633: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttctgcgccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtctgcggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaag

SEQ ID NO: 11826 - RNA, 3633 nt, synthetic construct
  misc_feature 1..3633: note = SARS-CoV-2/Wuhan/WIV05/2019__EPI_ISL_402128 spike protein CDS gc (1-1211)(I909C_Y1047C)
  source 1..3633: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggctgcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtgccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaag

SEQ ID NO: 11827 - RNA, 3633 nt, synthetic construct
  misc_feature 1..3633: note = SARS-CoV-2/Wuhan/WIV05/2019__EPI_ISL_402128 spike protein CDS gc (1-1211)(Q965C_S1003C)
  source 1..3633: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagtgcctgtccagcaacttcggcgccatctccagcgtgctgaacgacatcctctcccgcctggacaaggtcgaggccgaggtgcagatcgaccggctgatcaccgggcgcctccagtgcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaag

SEQ ID NO: 11828 - RNA, 3633 nt, synthetic construct
  misc_feature 1..3633: note = SARS-CoV-2/Wuhan/WIV05/2019__EPI_ISL_402128 spike protein CDS gc (1-1211)(F970C_G999C)
  source 1..3633: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaactgcggcgccatctccagcgtgctgaacgacatcctctcccgcctggacaaggtcgaggccgaggtgcagatcgaccggctgatcacctgtcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaag

SEQ ID NO: 11829 - RNA, 3633 nt, synthetic construct
  misc_feature 1..3633: note = SARS-CoV-2/Wuhan/WIV05/2019__EPI_ISL_402128 spike protein CDS gc (1-1211)(A972C_R995C)
  source 1..3633: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggctgcatctccagcgtgctgaacgacatcctctcccgcctggacaaggtcgaggccgaggtgcagatcgactgcctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaag

SEQ ID NO: 11830 - RNA, 3633 nt, synthetic construct
  misc_feature 1..3633: note = SARS-CoV-2/Wuhan/WIV05/2019__EPI_ISL_402128 spike protein CDS gc (1-1211)(A890C_V1040C)
  source 1..3633: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcgggtgcggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcggtgcgacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaag

SEQ ID NO: 11831 - RNA, 3633 nt, synthetic construct
  misc_feature 1..3633: note = SARS-CoV-2/Wuhan/WIV05/2019__EPI_ISL_402128 spike protein CDS gc (1-1211)(T874C_S1055C)
  source 1..3633: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtactgcagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagtgcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaag

SEQ ID NO: 11832 - RNA, 3441 nt, synthetic construct
  misc_feature 1..3441: note = SARS-CoV-2/Wuhan/WIV05/2019__EPI_ISL_402128 spike protein CDS gc (1-1147)
  source 1..3441: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactcc

SEQ ID NO: 11833 - RNA, 3441 nt, synthetic construct
  misc_feature 1..3441: note = SARS-CoV-2/Wuhan/WIV05/2019__EPI_ISL_402128 spike protein CDS gc (1-1147)(K986P_V987P)
  source 1..3441: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactcc

SEQ ID NO: 11834 - RNA, 3441 nt, synthetic construct
  misc_feature 1..3441: note = SARS-CoV-2/Wuhan/WIV05/2019__EPI_ISL_402128 spike protein CDS gc (1-1147)(K986P_V987P_T887WN_A1020W)
  source 1..3441: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggtggttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgctggagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactcc

SEQ ID NO: 11835 - RNA, 3441 nt, synthetic construct
  misc_feature 1..3441: note = SARS-CoV-2/Wuhan/WIV05/2019__EPI_ISL_402128 spike protein CDS gc (1-1147)(K986P_V987P_P1069F)
  source 1..3441: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtcttcgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactcc

SEQ ID NO: 11836 - RNA, 3441 nt, synthetic construct
  misc_feature 1..3441: note = SARS-CoV-2/Wuhan/WIV05/2019__EPI_ISL_402128 spike protein CDS gc (1-1147)(K986P_V987P_ H1048Q_H1064N_ H1083N_H1101N)
  source 1..3441: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccagctgatgtccttcccccagagcgccccgcacggcgtggtcttcctcaacgtgacgtacgtccccgcccaggagaagaacttcaccaccgcccccgcgatctgcaacgacgggaaggcccacttcccccgcgagggcgtgttcgtgtccaacgggaccaactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactcc

SEQ ID NO: 11837 - RNA, 3441 nt, synthetic construct
  misc_feature 1..3441: note = SARS-CoV-2/Wuhan/WIV05/2019__EPI_ISL_402128 spike protein CDS gc (1-1147)(I712C_T1077C)
  source 1..3441: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagctgcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcacctgcgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactcc

SEQ ID NO: 11838 - RNA, 3441 nt, synthetic construct
  misc_feature 1..3441: note = SARS-CoV-2/Wuhan/WIV05/2019__EPI_ISL_402128 spike protein CDS gc (1-1147)(I714C_Y1110C)
  source 1..3441: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgcctgccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctgcgagccgcagatcatcaccaccgacaacaccttcgtgagcggcaactgcgacgtggtcatcggcatcgtgaacaacacggtgtacgaccccctgcagcccgagctggactcc

SEQ ID NO: 11839 - RNA, 3441 nt, synthetic construct
  misc_feature 1..3441: note = SARS-CoV-2/Wuhan/WIV05/2019__EPI_ISL_402128 spike protein CDS gc (1-1147)(P715C_P1069C)
  source 1..3441: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatctgcaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtctgcgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactcc

SEQ ID NO: 11840 - RNA, 3441 nt, synthetic construct
  misc_feature 1..3441: note = SARS-CoV-2/Wuhan/WIV05/2019__EPI_ISL_402128 spike protein CDS gc (1-1147)(G889C_L1034C)
  source 1..3441: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttctgcgccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtctgcggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactcc

SEQ ID NO: 11841 - RNA, 3441 nt, synthetic construct
  misc_feature 1..3441: note = SARS-CoV-2/Wuhan/WIV05/2019__EPI_ISL_402128 spike protein CDS gc (1-1147)(I909C_Y1047C)
  source 1..3441: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggctgcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtgccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactcc

SEQ ID NO: 11842 - RNA, 3441 nt, synthetic construct
  misc_feature 1..3441: note = SARS-CoV-2/Wuhan/WIV05/2019__EPI_ISL_402128 spike protein CDS gc (1-1147)(Q965C_S1003C)
  source 1..3441: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagtgcctgtccagcaacttcggcgccatctccagcgtgctgaacgacatcctctcccgcctggacaaggtcgaggccgaggtgcagatcgaccggctgatcaccgggcgcctccagtgcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactcc

SEQ ID NO: 11843 - RNA, 3441 nt, synthetic construct
  misc_feature 1..3441: note = SARS-CoV-2/Wuhan/WIV05/2019__EPI_ISL_402128 spike protein CDS gc (1-1147)(F970C_G999C)
  source 1..3441: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaactgcggcgccatctccagcgtgctgaacgacatcctctcccgcctggacaaggtcgaggccgaggtgcagatcgaccggctgatcacctgtcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactcc

SEQ ID NO: 11844 - RNA, 3441 nt, synthetic construct
  misc_feature 1..3441: note = SARS-CoV-2/Wuhan/WIV05/2019__EPI_ISL_402128 spike protein CDS gc (1-1147)(A972C_R995C)
  source 1..3441: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggctgcatctccagcgtgctgaacgacatcctctcccgcctggacaaggtcgaggccgaggtgcagatcgactgcctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactcc

SEQ ID NO: 11845 - RNA, 3441 nt, synthetic construct
  misc_feature 1..3441: note = SARS-CoV-2/Wuhan/WIV05/2019__EPI_ISL_402128 spike protein CDS gc (1-1147)(A890C_V1040C)
  source 1..3441: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcgggtgcggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcggtgcgacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactcc

SEQ ID NO: 11846 - RNA, 3441 nt, synthetic construct
  misc_feature 1..3441: note = SARS-CoV-2/Wuhan/WIV05/2019__EPI_ISL_402128 spike protein CDS gc (1-1147)(T874C_S1055C)
  source 1..3441: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtactgcagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagtgcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactcc

SEQ ID NO: 11847 - RNA, 4116 nt, synthetic construct
  misc_feature 1..4116: note = SARS-CoV-2/Wuhan/WIV05/2019__EPI_ISL_402128 spike protein CDS gc (1-1211) LumSynth construct
  source 1..4116: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcggcgggagcgggggcgggcagatctacgagggcaagctgaccgccgaggggctccgcttcggcatcgtggccagccggttcaaccacgcgctggtcgaccgcctggtggagggggccatcgacgccatcgtgcggcacggcgggcgcgaggaggacatcaccctcgtccgggtgcccggctcctgggagatcccggtggccgccggcgagctggcccgcaaggaggacatcgacgcggtcatcgccatcggggtgctgatccggggcgccacgccccacttcgactacatcgccagcgaggtgtccaaggggctcgcggacctgagcctggagctccgcaagcccatcaccttcggcgtcatcaccgccgacaccctggagcaggccatcgagcgggccgggacgaagcacggcaacaagggctgggaggccgcgctgtccgccatcgagatggccaacctcttcaagagcctgcgctga

SEQ ID NO: 11848 - RNA, 4116 nt, synthetic construct
  misc_feature 1..4116: note = SARS-CoV-2/Wuhan/WIV05/2019__EPI_ISL_402128 spike protein CDS gc (1-1211)(K986P_V987P) LumSynth construct
  source 1..4116: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcggcgggagcgggggcgggcagatctacgagggcaagctgaccgccgaggggctccgcttcggcatcgtggccagccggttcaaccacgcgctggtcgaccgcctggtggagggggccatcgacgccatcgtgcggcacggcgggcgcgaggaggacatcaccctcgtccgggtgcccggctcctgggagatcccggtggccgccggcgagctggcccgcaaggaggacatcgacgcggtcatcgccatcggggtgctgatccggggcgccacgccccacttcgactacatcgccagcgaggtgtccaaggggctcgcggacctgagcctggagctccgcaagcccatcaccttcggcgtcatcaccgccgacaccctggagcaggccatcgagcgggccgggacgaagcacggcaacaagggctgggaggccgcgctgtccgccatcgagatggccaacctcttcaagagcctgcgctga

SEQ ID NO: 11849 - RNA, 4116 nt, synthetic construct
  misc_feature 1..4116: note = SARS-CoV-2/Wuhan/WIV05/2019__EPI_ISL_402128 spike protein CDS gc (1-1211)(K986P_V987P_T887WN_A1020W) LumSynth construct
  source 1..4116: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggtggttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgctggagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcggcgggagcgggggcgggcagatctacgagggcaagctgaccgccgaggggctccgcttcggcatcgtggccagccggttcaaccacgcgctggtcgaccgcctggtggagggggccatcgacgccatcgtgcggcacggcgggcgcgaggaggacatcaccctcgtccgggtgcccggctcctgggagatcccggtggccgccggcgagctggcccgcaaggaggacatcgacgcggtcatcgccatcggggtgctgatccggggcgccacgccccacttcgactacatcgccagcgaggtgtccaaggggctcgcggacctgagcctggagctccgcaagcccatcaccttcggcgtcatcaccgccgacaccctggagcaggccatcgagcgggccgggacgaagcacggcaacaagggctgggaggccgcgctgtccgccatcgagatggccaacctcttcaagagcctgcgctga

SEQ ID NO: 11850 - RNA, 4116 nt, synthetic construct
  misc_feature 1..4116: note = SARS-CoV-2/Wuhan/WIV05/2019__EPI_ISL_402128 spike protein CDS gc (1-1211)(K986P_V987P_P1069F) LumSynth construct
  source 1..4116: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtcttcgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcggcgggagcgggggcgggcagatctacgagggcaagctgaccgccgaggggctccgcttcggcatcgtggccagccggttcaaccacgcgctggtcgaccgcctggtggagggggccatcgacgccatcgtgcggcacggcgggcgcgaggaggacatcaccctcgtccgggtgcccggctcctgggagatcccggtggccgccggcgagctggcccgcaaggaggacatcgacgcggtcatcgccatcggggtgctgatccggggcgccacgccccacttcgactacatcgccagcgaggtgtccaaggggctcgcggacctgagcctggagctccgcaagcccatcaccttcggcgtcatcaccgccgacaccctggagcaggccatcgagcgggccgggacgaagcacggcaacaagggctgggaggccgcgctgtccgccatcgagatggccaacctcttcaagagcctgcgctga

SEQ ID NO: 11851 - RNA, 4116 nt, synthetic construct
  misc_feature 1..4116: note = SARS-CoV-2/Wuhan/WIV05/2019__EPI_ISL_402128 spike protein CDS gc (1-1211)(K986P_V987P_ H1048Q_H1064N_ H1083N_H1101N) LumSynth construct
  source 1..4116: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccagctgatgtccttcccccagagcgccccgcacggcgtggtcttcctcaacgtgacgtacgtccccgcccaggagaagaacttcaccaccgcccccgcgatctgcaacgacgggaaggcccacttcccccgcgagggcgtgttcgtgtccaacgggaccaactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcggcgggagcgggggcgggcagatctacgagggcaagctgaccgccgaggggctccgcttcggcatcgtggccagccggttcaaccacgcgctggtcgaccgcctggtggagggggccatcgacgccatcgtgcggcacggcgggcgcgaggaggacatcaccctcgtccgggtgcccggctcctgggagatcccggtggccgccggcgagctggcccgcaaggaggacatcgacgcggtcatcgccatcggggtgctgatccggggcgccacgccccacttcgactacatcgccagcgaggtgtccaaggggctcgcggacctgagcctggagctccgcaagcccatcaccttcggcgtcatcaccgccgacaccctggagcaggccatcgagcgggccgggacgaagcacggcaacaagggctgggaggccgcgctgtccgccatcgagatggccaacctcttcaagagcctgcgctga

SEQ ID NO: 11852 - RNA, 4116 nt, synthetic construct
  misc_feature 1..4116: note = SARS-CoV-2/Wuhan/WIV05/2019__EPI_ISL_402128 spike protein CDS gc (1-1211)(I712C_T1077C) LumSynth construct
  source 1..4116: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagctgcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcacctgcgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcggcgggagcgggggcgggcagatctacgagggcaagctgaccgccgaggggctccgcttcggcatcgtggccagccggttcaaccacgcgctggtcgaccgcctggtggagggggccatcgacgccatcgtgcggcacggcgggcgcgaggaggacatcaccctcgtccgggtgcccggctcctgggagatcccggtggccgccggcgagctggcccgcaaggaggacatcgacgcggtcatcgccatcggggtgctgatccggggcgccacgccccacttcgactacatcgccagcgaggtgtccaaggggctcgcggacctgagcctggagctccgcaagcccatcaccttcggcgtcatcaccgccgacaccctggagcaggccatcgagcgggccgggacgaagcacggcaacaagggctgggaggccgcgctgtccgccatcgagatggccaacctcttcaagagcctgcgctga

SEQ ID NO: 11853 - RNA, 4116 nt, synthetic construct
  misc_feature 1..4116: note = SARS-CoV-2/Wuhan/WIV05/2019__EPI_ISL_402128 spike protein CDS gc (1-1211)(I714C_Y1110C) LumSynth construct
  source 1..4116: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgcctgccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctgcgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcggcgggagcgggggcgggcagatctacgagggcaagctgaccgccgaggggctccgcttcggcatcgtggccagccggttcaaccacgcgctggtcgaccgcctggtggagggggccatcgacgccatcgtgcggcacggcgggcgcgaggaggacatcaccctcgtccgggtgcccggctcctgggagatcccggtggccgccggcgagctggcccgcaaggaggacatcgacgcggtcatcgccatcggggtgctgatccggggcgccacgccccacttcgactacatcgccagcgaggtgtccaaggggctcgcggacctgagcctggagctccgcaagcccatcaccttcggcgtcatcaccgccgacaccctggagcaggccatcgagcgggccgggacgaagcacggcaacaagggctgggaggccgcgctgtccgccatcgagatggccaacctcttcaagagcctgcgctga

SEQ ID NO: 11854 - RNA, 4116 nt, synthetic construct
  misc_feature 1..4116: note = SARS-CoV-2/Wuhan/WIV05/2019__EPI_ISL_402128 spike protein CDS gc (1-1211)(P715C_P1069C) LumSynth construct
  source 1..4116: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatctgcaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtctgcgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcggcgggagcgggggcgggcagatctacgagggcaagctgaccgccgaggggctccgcttcggcatcgtggccagccggttcaaccacgcgctggtcgaccgcctggtggagggggccatcgacgccatcgtgcggcacggcgggcgcgaggaggacatcaccctcgtccgggtgcccggctcctgggagatcccggtggccgccggcgagctggcccgcaaggaggacatcgacgcggtcatcgccatcggggtgctgatccggggcgccacgccccacttcgactacatcgccagcgaggtgtccaaggggctcgcggacctgagcctggagctccgcaagcccatcaccttcggcgtcatcaccgccgacaccctggagcaggccatcgagcgggccgggacgaagcacggcaacaagggctgggaggccgcgctgtccgccatcgagatggccaacctcttcaagagcctgcgctga

SEQ ID NO: 11855 - RNA, 4116 nt, synthetic construct
  misc_feature 1..4116: note = SARS-CoV-2/Wuhan/WIV05/2019__EPI_ISL_402128 spike protein CDS gc (1-1211)(G889C_L1034C) LumSynth construct
  source 1..4116: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttctgcgccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtctgcggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcggcgggagcgggggcgggcagatctacgagggcaagctgaccgccgaggggctccgcttcggcatcgtggccagccggttcaaccacgcgctggtcgaccgcctggtggagggggccatcgacgccatcgtgcggcacggcgggcgcgaggaggacatcaccctcgtccgggtgcccggctcctgggagatcccggtggccgccggcgagctggcccgcaaggaggacatcgacgcggtcatcgccatcggggtgctgatccggggcgccacgccccacttcgactacatcgccagcgaggtgtccaaggggctcgcggacctgagcctggagctccgcaagcccatcaccttcggcgtcatcaccgccgacaccctggagcaggccatcgagcgggccgggacgaagcacggcaacaagggctgggaggccgcgctgtccgccatcgagatggccaacctcttcaagagcctgcgctga

SEQ ID NO: 11856 - RNA, 4116 nt, synthetic construct
  misc_feature 1..4116: note = SARS-CoV-2/Wuhan/WIV05/2019__EPI_ISL_402128 spike protein CDS gc (1-1211)(I909C_Y1047C) LumSynth construct
  source 1..4116: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggctgcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtgccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcggcgggagcgggggcgggcagatctacgagggcaagctgaccgccgaggggctccgcttcggcatcgtggccagccggttcaaccacgcgctggtcgaccgcctggtggagggggccatcgacgccatcgtgcggcacggcgggcgcgaggaggacatcaccctcgtccgggtgcccggctcctgggagatcccggtggccgccggcgagctggcccgcaaggaggacatcgacgcggtcatcgccatcggggtgctgatccggggcgccacgccccacttcgactacatcgccagcgaggtgtccaaggggctcgcggacctgagcctggagctccgcaagcccatcaccttcggcgtcatcaccgccgacaccctggagcaggccatcgagcgggccgggacgaagcacggcaacaagggctgggaggccgcgctgtccgccatcgagatggccaacctcttcaagagcctgcgctga

SEQ ID NO: 11857 - RNA, 4116 nt, synthetic construct
  misc_feature 1..4116: note = SARS-CoV-2/Wuhan/WIV05/2019__EPI_ISL_402128 spike protein CDS gc (1-1211)(Q965C_S1003C) LumSynth construct
  source 1..4116: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagtgcctgtccagcaacttcggcgccatctccagcgtgctgaacgacatcctctcccgcctggacaaggtcgaggccgaggtgcagatcgaccggctgatcaccgggcgcctccagtgcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcggcgggagcgggggcgggcagatctacgagggcaagctgaccgccgaggggctccgcttcggcatcgtggccagccggttcaaccacgcgctggtcgaccgcctggtggagggggccatcgacgccatcgtgcggcacggcgggcgcgaggaggacatcaccctcgtccgggtgcccggctcctgggagatcccggtggccgccggcgagctggcccgcaaggaggacatcgacgcggtcatcgccatcggggtgctgatccggggcgccacgccccacttcgactacatcgccagcgaggtgtccaaggggctcgcggacctgagcctggagctccgcaagcccatcaccttcggcgtcatcaccgccgacaccctggagcaggccatcgagcgggccgggacgaagcacggcaacaagggctgggaggccgcgctgtccgccatcgagatggccaacctcttcaagagcctgcgctga

SEQ ID NO: 11858 - RNA, 4116 nt, synthetic construct
  misc_feature 1..4116: note = SARS-CoV-2/Wuhan/WIV05/2019__EPI_ISL_402128 spike protein CDS gc (1-1211)(F970C_G999C) LumSynth construct
  source 1..4116: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaactgcggcgccatctccagcgtgctgaacgacatcctctcccgcctggacaaggtcgaggccgaggtgcagatcgaccggctgatcacctgtcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcggcgggagcgggggcgggcagatctacgagggcaagctgaccgccgaggggctccgcttcggcatcgtggccagccggttcaaccacgcgctggtcgaccgcctggtggagggggccatcgacgccatcgtgcggcacggcgggcgcgaggaggacatcaccctcgtccgggtgcccggctcctgggagatcccggtggccgccggcgagctggcccgcaaggaggacatcgacgcggtcatcgccatcggggtgctgatccggggcgccacgccccacttcgactacatcgccagcgaggtgtccaaggggctcgcggacctgagcctggagctccgcaagcccatcaccttcggcgtcatcaccgccgacaccctggagcaggccatcgagcgggccgggacgaagcacggcaacaagggctgggaggccgcgctgtccgccatcgagatggccaacctcttcaagagcctgcgctga

SEQ ID NO: 11859 - RNA, 4116 nt, synthetic construct
  misc_feature 1..4116: note = SARS-CoV-2/Wuhan/WIV05/2019__EPI_ISL_402128 spike protein CDS gc (1-1211)(A972C_R995C) LumSynth construct
  source 1..4116: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggctgcatctccagcgtgctgaacgacatcctctcccgcctggacaaggtcgaggccgaggtgcagatcgactgcctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcggcgggagcgggggcgggcagatctacgagggcaagctgaccgccgaggggctccgcttcggcatcgtggccagccggttcaaccacgcgctggtcgaccgcctggtggagggggccatcgacgccatcgtgcggcacggcgggcgcgaggaggacatcaccctcgtccgggtgcccggctcctgggagatcccggtggccgccggcgagctggcccgcaaggaggacatcgacgcggtcatcgccatcggggtgctgatccggggcgccacgccccacttcgactacatcgccagcgaggtgtccaaggggctcgcggacctgagcctggagctccgcaagcccatcaccttcggcgtcatcaccgccgacaccctggagcaggccatcgagcgggccgggacgaagcacggcaacaagggctgggaggccgcgctgtccgccatcgagatggccaacctcttcaagagcctgcgctga

SEQ ID NO: 11860 - RNA, 4116 nt, synthetic construct
  misc_feature 1..4116: note = SARS-CoV-2/Wuhan/WIV05/2019__EPI_ISL_402128 spike protein CDS gc (1-1211)(A890C_V1040C) LumSynth construct
  source 1..4116: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcgggtgcggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcggtgcgacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcggcgggagcgggggcgggcagatctacgagggcaagctgaccgccgaggggctccgcttcggcatcgtggccagccggttcaaccacgcgctggtcgaccgcctggtggagggggccatcgacgccatcgtgcggcacggcgggcgcgaggaggacatcaccctcgtccgggtgcccggctcctgggagatcccggtggccgccggcgagctggcccgcaaggaggacatcgacgcggtcatcgccatcggggtgctgatccggggcgccacgccccacttcgactacatcgccagcgaggtgtccaaggggctcgcggacctgagcctggagctccgcaagcccatcaccttcggcgtcatcaccgccgacaccctggagcaggccatcgagcgggccgggacgaagcacggcaacaagggctgggaggccgcgctgtccgccatcgagatggccaacctcttcaagagcctgcgctga

SEQ ID NO: 11861 - RNA, 4116 nt, synthetic construct
  misc_feature 1..4116: note = SARS-CoV-2/Wuhan/WIV05/2019__EPI_ISL_402128 spike protein CDS gc (1-1211)(T874C_S1055C) LumSynth construct
  source 1..4116: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtactgcagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagtgcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcggcgggagcgggggcgggcagatctacgagggcaagctgaccgccgaggggctccgcttcggcatcgtggccagccggttcaaccacgcgctggtcgaccgcctggtggagggggccatcgacgccatcgtgcggcacggcgggcgcgaggaggacatcaccctcgtccgggtgcccggctcctgggagatcccggtggccgccggcgagctggcccgcaaggaggacatcgacgcggtcatcgccatcggggtgctgatccggggcgccacgccccacttcgactacatcgccagcgaggtgtccaaggggctcgcggacctgagcctggagctccgcaagcccatcaccttcggcgtcatcaccgccgacaccctggagcaggccatcgagcgggccgggacgaagcacggcaacaagggctgggaggccgcgctgtccgccatcgagatggccaacctcttcaagagcctgcgctga

SEQ ID NO: 11862 - RNA, 4140 nt, synthetic construct
  misc_feature 1..4140: note = SARS-CoV-2/Wuhan/WIV05/2019__EPI_ISL_402128 spike protein CDS gc (1-1211) Ferritin construct
  source 1..4140: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcgggggcgggagcgacatcatcaagctcctgaacgagcaggtcaacaaggagatgcagtccagcaacctgtacatgtccatgagctcctggtgctacacccacagcctcgacggcgccgggctgttcctgttcgaccacgccgcggaggagtacgagcacgccaagaagctcatcatcttcctgaacgagaacaacgtgcccgtgcagctgacctccatcagcgccccggagcacaagttcgagggcctcacgcagatcttccagaaggcctacgagcacgagcagcacatctccgagagcatcaacaacatcgtggaccacgccatcaagtccaaggaccacgcgaccttcaacttcctgcagtggtacgtcgccgagcagcacgaggaggaggtgctgttcaaggacatcctcgacaagatcgagctgatcgggaacgagaaccacggcctgtacctcgccgaccagtacgtgaaggggatcgccaagagccgcaagtcctga

SEQ ID NO: 11863 - RNA, 4140 nt, synthetic construct
  misc_feature 1..4140: note = SARS-CoV-2/Wuhan/WIV05/2019__EPI_ISL_402128 spike protein CDS gc (1-1211)(K986P_V987P) Ferritin construct
  source 1..4140: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcgggggcgggagcgacatcatcaagctcctgaacgagcaggtcaacaaggagatgcagtccagcaacctgtacatgtccatgagctcctggtgctacacccacagcctcgacggcgccgggctgttcctgttcgaccacgccgcggaggagtacgagcacgccaagaagctcatcatcttcctgaacgagaacaacgtgcccgtgcagctgacctccatcagcgccccggagcacaagttcgagggcctcacgcagatcttccagaaggcctacgagcacgagcagcacatctccgagagcatcaacaacatcgtggaccacgccatcaagtccaaggaccacgcgaccttcaacttcctgcagtggtacgtcgccgagcagcacgaggaggaggtgctgttcaaggacatcctcgacaagatcgagctgatcgggaacgagaaccacggcctgtacctcgccgaccagtacgtgaaggggatcgccaagagccgcaagtcctga

SEQ ID NO: 11864 - RNA, 4140 nt, synthetic construct
  misc_feature 1..4140: note = SARS-CoV-2/Wuhan/WIV05/2019__EPI_ISL_402128 spike protein CDS gc (1-1211)(K986P_V987P_T887WN_A1020W) Ferritin construct
  source 1..4140: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggtggttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgctggagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcgggggcgggagcgacatcatcaagctcctgaacgagcaggtcaacaaggagatgcagtccagcaacctgtacatgtccatgagctcctggtgctacacccacagcctcgacggcgccgggctgttcctgttcgaccacgccgcggaggagtacgagcacgccaagaagctcatcatcttcctgaacgagaacaacgtgcccgtgcagctgacctccatcagcgccccggagcacaagttcgagggcctcacgcagatcttccagaaggcctacgagcacgagcagcacatctccgagagcatcaacaacatcgtggaccacgccatcaagtccaaggaccacgcgaccttcaacttcctgcagtggtacgtcgccgagcagcacgaggaggaggtgctgttcaaggacatcctcgacaagatcgagctgatcgggaacgagaaccacggcctgtacctcgccgaccagtacgtgaaggggatcgccaagagccgcaagtcctga

SEQ ID NO: 11865 - RNA, 4140 nt, synthetic construct
  misc_feature 1..4140: note = SARS-CoV-2/Wuhan/WIV05/2019__EPI_ISL_402128 spike protein CDS gc (1-1211)(K986P_V987P_P1069F) Ferritin construct
  source 1..4140: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtcttcgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcgggggcgggagcgacatcatcaagctcctgaacgagcaggtcaacaaggagatgcagtccagcaacctgtacatgtccatgagctcctggtgctacacccacagcctcgacggcgccgggctgttcctgttcgaccacgccgcggaggagtacgagcacgccaagaagctcatcatcttcctgaacgagaacaacgtgcccgtgcagctgacctccatcagcgccccggagcacaagttcgagggcctcacgcagatcttccagaaggcctacgagcacgagcagcacatctccgagagcatcaacaacatcgtggaccacgccatcaagtccaaggaccacgcgaccttcaacttcctgcagtggtacgtcgccgagcagcacgaggaggaggtgctgttcaaggacatcctcgacaagatcgagctgatcgggaacgagaaccacggcctgtacctcgccgaccagtacgtgaaggggatcgccaagagccgcaagtcctga

SEQ ID NO: 11866 - RNA, 4140 nt, synthetic construct
  misc_feature 1..4140: note = SARS-CoV-2/Wuhan/WIV05/2019__EPI_ISL_402128 spike protein CDS gc (1-1211)(K986P_V987P_ H1048Q_H1064N_ H1083N_H1101N) Ferritin construct
  source 1..4140: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccagctgatgtccttcccccagagcgccccgcacggcgtggtcttcctcaacgtgacgtacgtccccgcccaggagaagaacttcaccaccgcccccgcgatctgcaacgacgggaaggcccacttcccccgcgagggcgtgttcgtgtccaacgggaccaactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcgggggcgggagcgacatcatcaagctcctgaacgagcaggtcaacaaggagatgcagtccagcaacctgtacatgtccatgagctcctggtgctacacccacagcctcgacggcgccgggctgttcctgttcgaccacgccgcggaggagtacgagcacgccaagaagctcatcatcttcctgaacgagaacaacgtgcccgtgcagctgacctccatcagcgccccggagcacaagttcgagggcctcacgcagatcttccagaaggcctacgagcacgagcagcacatctccgagagcatcaacaacatcgtggaccacgccatcaagtccaaggaccacgcgaccttcaacttcctgcagtggtacgtcgccgagcagcacgaggaggaggtgctgttcaaggacatcctcgacaagatcgagctgatcgggaacgagaaccacggcctgtacctcgccgaccagtacgtgaaggggatcgccaagagccgcaagtcctga

SEQ ID NO: 11867 - RNA, 4140 nt, synthetic construct
  misc_feature 1..4140: note = SARS-CoV-2/Wuhan/WIV05/2019__EPI_ISL_402128 spike protein CDS gc (1-1211)(I712C_T1077C) Ferritin construct
  source 1..4140: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagctgcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcacctgcgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcgggggcgggagcgacatcatcaagctcctgaacgagcaggtcaacaaggagatgcagtccagcaacctgtacatgtccatgagctcctggtgctacacccacagcctcgacggcgccgggctgttcctgttcgaccacgccgcggaggagtacgagcacgccaagaagctcatcatcttcctgaacgagaacaacgtgcccgtgcagctgacctccatcagcgccccggagcacaagttcgagggcctcacgcagatcttccagaaggcctacgagcacgagcagcacatctccgagagcatcaacaacatcgtggaccacgccatcaagtccaaggaccacgcgaccttcaacttcctgcagtggtacgtcgccgagcagcacgaggaggaggtgctgttcaaggacatcctcgacaagatcgagctgatcgggaacgagaaccacggcctgtacctcgccgaccagtacgtgaaggggatcgccaagagccgcaagtcctga

SEQ ID NO: 11868 - RNA, 4140 nt, synthetic construct
  misc_feature 1..4140: note = SARS-CoV-2/Wuhan/WIV05/2019__EPI_ISL_402128 spike protein CDS gc (1-1211)(I714C_Y1110C) Ferritin construct
  source 1..4140: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgcctgccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctgcgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcgggggcgggagcgacatcatcaagctcctgaacgagcaggtcaacaaggagatgcagtccagcaacctgtacatgtccatgagctcctggtgctacacccacagcctcgacggcgccgggctgttcctgttcgaccacgccgcggaggagtacgagcacgccaagaagctcatcatcttcctgaacgagaacaacgtgcccgtgcagctgacctccatcagcgccccggagcacaagttcgagggcctcacgcagatcttccagaaggcctacgagcacgagcagcacatctccgagagcatcaacaacatcgtggaccacgccatcaagtccaaggaccacgcgaccttcaacttcctgcagtggtacgtcgccgagcagcacgaggaggaggtgctgttcaaggacatcctcgacaagatcgagctgatcgggaacgagaaccacggcctgtacctcgccgaccagtacgtgaaggggatcgccaagagccgcaagtcctga

SEQ ID NO: 11869 - RNA, 4140 nt, synthetic construct
  misc_feature 1..4140: note = SARS-CoV-2/Wuhan/WIV05/2019__EPI_ISL_402128 spike protein CDS gc (1-1211)(P715C_P1069C) Ferritin construct
  source 1..4140: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatctgcaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtctgcgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcgggggcgggagcgacatcatcaagctcctgaacgagcaggtcaacaaggagatgcagtccagcaacctgtacatgtccatgagctcctggtgctacacccacagcctcgacggcgccgggctgttcctgttcgaccacgccgcggaggagtacgagcacgccaagaagctcatcatcttcctgaacgagaacaacgtgcccgtgcagctgacctccatcagcgccccggagcacaagttcgagggcctcacgcagatcttccagaaggcctacgagcacgagcagcacatctccgagagcatcaacaacatcgtggaccacgccatcaagtccaaggaccacgcgaccttcaacttcctgcagtggtacgtcgccgagcagcacgaggaggaggtgctgttcaaggacatcctcgacaagatcgagctgatcgggaacgagaaccacggcctgtacctcgccgaccagtacgtgaaggggatcgccaagagccgcaagtcctga

SEQ ID NO: 11870 - RNA, 4140 nt, synthetic construct
  misc_feature 1..4140: note = SARS-CoV-2/Wuhan/WIV05/2019__EPI_ISL_402128 spike protein CDS gc (1-1211)(G889C_L1034C) Ferritin construct
  source 1..4140: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttctgcgccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtctgcggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcgggggcgggagcgacatcatcaagctcctgaacgagcaggtcaacaaggagatgcagtccagcaacctgtacatgtccatgagctcctggtgctacacccacagcctcgacggcgccgggctgttcctgttcgaccacgccgcggaggagtacgagcacgccaagaagctcatcatcttcctgaacgagaacaacgtgcccgtgcagctgacctccatcagcgccccggagcacaagttcgagggcctcacgcagatcttccagaaggcctacgagcacgagcagcacatctccgagagcatcaacaacatcgtggaccacgccatcaagtccaaggaccacgcgaccttcaacttcctgcagtggtacgtcgccgagcagcacgaggaggaggtgctgttcaaggacatcctcgacaagatcgagctgatcgggaacgagaaccacggcctgtacctcgccgaccagtacgtgaaggggatcgccaagagccgcaagtcctga

SEQ ID NO: 11871 - RNA, 4140 nt, synthetic construct
  misc_feature 1..4140: note = SARS-CoV-2/Wuhan/WIV05/2019__EPI_ISL_402128 spike protein CDS gc (1-1211)(I909C_Y1047C) Ferritin construct
  source 1..4140: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggctgcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtgccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcgggggcgggagcgacatcatcaagctcctgaacgagcaggtcaacaaggagatgcagtccagcaacctgtacatgtccatgagctcctggtgctacacccacagcctcgacggcgccgggctgttcctgttcgaccacgccgcggaggagtacgagcacgccaagaagctcatcatcttcctgaacgagaacaacgtgcccgtgcagctgacctccatcagcgccccggagcacaagttcgagggcctcacgcagatcttccagaaggcctacgagcacgagcagcacatctccgagagcatcaacaacatcgtggaccacgccatcaagtccaaggaccacgcgaccttcaacttcctgcagtggtacgtcgccgagcagcacgaggaggaggtgctgttcaaggacatcctcgacaagatcgagctgatcgggaacgagaaccacggcctgtacctcgccgaccagtacgtgaaggggatcgccaagagccgcaagtcctga

SEQ ID NO: 11872 - RNA, 4140 nt, synthetic construct
  misc_feature 1..4140: note = SARS-CoV-2/Wuhan/WIV05/2019__EPI_ISL_402128 spike protein CDS gc (1-1211)(Q965C_S1003C) Ferritin construct
  source 1..4140: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagtgcctgtccagcaacttcggcgccatctccagcgtgctgaacgacatcctctcccgcctggacaaggtcgaggccgaggtgcagatcgaccggctgatcaccgggcgcctccagtgcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcgggggcgggagcgacatcatcaagctcctgaacgagcaggtcaacaaggagatgcagtccagcaacctgtacatgtccatgagctcctggtgctacacccacagcctcgacggcgccgggctgttcctgttcgaccacgccgcggaggagtacgagcacgccaagaagctcatcatcttcctgaacgagaacaacgtgcccgtgcagctgacctccatcagcgccccggagcacaagttcgagggcctcacgcagatcttccagaaggcctacgagcacgagcagcacatctccgagagcatcaacaacatcgtggaccacgccatcaagtccaaggaccacgcgaccttcaacttcctgcagtggtacgtcgccgagcagcacgaggaggaggtgctgttcaaggacatcctcgacaagatcgagctgatcgggaacgagaaccacggcctgtacctcgccgaccagtacgtgaaggggatcgccaagagccgcaagtcctga

SEQ ID NO: 11873 - RNA, 4140 nt, synthetic construct
  misc_feature 1..4140: note = SARS-CoV-2/Wuhan/WIV05/2019__EPI_ISL_402128 spike protein CDS gc (1-1211)(F970C_G999C) Ferritin construct
  source 1..4140: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaactgcggcgccatctccagcgtgctgaacgacatcctctcccgcctggacaaggtcgaggccgaggtgcagatcgaccggctgatcacctgtcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcgggggcgggagcgacatcatcaagctcctgaacgagcaggtcaacaaggagatgcagtccagcaacctgtacatgtccatgagctcctggtgctacacccacagcctcgacggcgccgggctgttcctgttcgaccacgccgcggaggagtacgagcacgccaagaagctcatcatcttcctgaacgagaacaacgtgcccgtgcagctgacctccatcagcgccccggagcacaagttcgagggcctcacgcagatcttccagaaggcctacgagcacgagcagcacatctccgagagcatcaacaacatcgtggaccacgccatcaagtccaaggaccacgcgaccttcaacttcctgcagtggtacgtcgccgagcagcacgaggaggaggtgctgttcaaggacatcctcgacaagatcgagctgatcgggaacgagaaccacggcctgtacctcgccgaccagtacgtgaaggggatcgccaagagccgcaagtcctga

SEQ ID NO: 11874 - RNA, 4140 nt, synthetic construct
  misc_feature 1..4140: note = SARS-CoV-2/Wuhan/WIV05/2019__EPI_ISL_402128 spike protein CDS gc (1-1211)(A972C_R995C) Ferritin construct
  source 1..4140: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggctgcatctccagcgtgctgaacgacatcctctcccgcctggacaaggtcgaggccgaggtgcagatcgactgcctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcgggggcgggagcgacatcatcaagctcctgaacgagcaggtcaacaaggagatgcagtccagcaacctgtacatgtccatgagctcctggtgctacacccacagcctcgacggcgccgggctgttcctgttcgaccacgccgcggaggagtacgagcacgccaagaagctcatcatcttcctgaacgagaacaacgtgcccgtgcagctgacctccatcagcgccccggagcacaagttcgagggcctcacgcagatcttccagaaggcctacgagcacgagcagcacatctccgagagcatcaacaacatcgtggaccacgccatcaagtccaaggaccacgcgaccttcaacttcctgcagtggtacgtcgccgagcagcacgaggaggaggtgctgttcaaggacatcctcgacaagatcgagctgatcgggaacgagaaccacggcctgtacctcgccgaccagtacgtgaaggggatcgccaagagccgcaagtcctga

SEQ ID NO: 11875 - RNA, 4140 nt, synthetic construct
  misc_feature 1..4140: note = SARS-CoV-2/Wuhan/WIV05/2019__EPI_ISL_402128 spike protein CDS gc (1-1211)(A890C_V1040C) Ferritin construct
  source 1..4140: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcgggtgcggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcggtgcgacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcgggggcgggagcgacatcatcaagctcctgaacgagcaggtcaacaaggagatgcagtccagcaacctgtacatgtccatgagctcctggtgctacacccacagcctcgacggcgccgggctgttcctgttcgaccacgccgcggaggagtacgagcacgccaagaagctcatcatcttcctgaacgagaacaacgtgcccgtgcagctgacctccatcagcgccccggagcacaagttcgagggcctcacgcagatcttccagaaggcctacgagcacgagcagcacatctccgagagcatcaacaacatcgtggaccacgccatcaagtccaaggaccacgcgaccttcaacttcctgcagtggtacgtcgccgagcagcacgaggaggaggtgctgttcaaggacatcctcgacaagatcgagctgatcgggaacgagaaccacggcctgtacctcgccgaccagtacgtgaaggggatcgccaagagccgcaagtcctga

SEQ ID NO: 11876 - RNA, 4140 nt, synthetic construct
  misc_feature 1..4140: note = SARS-CoV-2/Wuhan/WIV05/2019__EPI_ISL_402128 spike protein CDS gc (1-1211)(T874C_S1055C) Ferritin construct
  source 1..4140: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtactgcagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagtgcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcgggggcgggagcgacatcatcaagctcctgaacgagcaggtcaacaaggagatgcagtccagcaacctgtacatgtccatgagctcctggtgctacacccacagcctcgacggcgccgggctgttcctgttcgaccacgccgcggaggagtacgagcacgccaagaagctcatcatcttcctgaacgagaacaacgtgcccgtgcagctgacctccatcagcgccccggagcacaagttcgagggcctcacgcagatcttccagaaggcctacgagcacgagcagcacatctccgagagcatcaacaacatcgtggaccacgccatcaagtccaaggaccacgcgaccttcaacttcctgcagtggtacgtcgccgagcagcacgaggaggaggtgctgttcaaggacatcctcgacaagatcgagctgatcgggaacgagaaccacggcctgtacctcgccgaccagtacgtgaaggggatcgccaagagccgcaagtcctga

SEQ ID NO: 11877 - RNA, 3726 nt, synthetic construct
  misc_feature 1..3726: note = SARS-CoV-2/Wuhan/WIV05/2019__EPI_ISL_402128 spike protein CDS gc (1-1211) Foldon construct
  source 1..3726: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcgggagcggctacatccccgaggccccgcgcgacgggcaggcctacgtgcggaaggacggcgagtgggtcctgctcagcaccttcctgtga

SEQ ID NO: 11878 - RNA, 3726 nt, synthetic construct
  misc_feature 1..3726: note = SARS-CoV-2/Wuhan/WIV05/2019__EPI_ISL_402128 spike protein CDS gc (1-1211)(K986P_V987P) Foldon construct
  source 1..3726: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcgggagcggctacatccccgaggccccgcgcgacgggcaggcctacgtgcggaaggacggcgagtgggtcctgctcagcaccttcctgtga

SEQ ID NO: 11879 - RNA, 3726 nt, synthetic construct
  misc_feature 1..3726: note = SARS-CoV-2/Wuhan/WIV05/2019__EPI_ISL_402128 spike protein CDS gc (1-1211)(K986P_V987P_T887WN_A1020W) Foldon construct
  source 1..3726: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggtggttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgctggagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcgggagcggctacatccccgaggccccgcgcgacgggcaggcctacgtgcggaaggacggcgagtgggtcctgctcagcaccttcctgtga

SEQ ID NO: 11880 - RNA, 3726 nt, synthetic construct
  misc_feature 1..3726: note = SARS-CoV-2/Wuhan/WIV05/2019__EPI_ISL_402128 spike protein CDS gc (1-1211)(K986P_V987P_P1069F) Foldon construct
  source 1..3726: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtcttcgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcgggagcggctacatccccgaggccccgcgcgacgggcaggcctacgtgcggaaggacggcgagtgggtcctgctcagcaccttcctgtga

SEQ ID NO: 11881 - RNA, 3726 nt, synthetic construct
  misc_feature 1..3726: note = SARS-CoV-2/Wuhan/WIV05/2019__EPI_ISL_402128 spike protein CDS gc (1-1211)(K986P_V987P_ H1048Q_H1064N_ H1083N_H1101N) Foldon construct
  source 1..3726: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccagctgatgtccttcccccagagcgccccgcacggcgtggtcttcctcaacgtgacgtacgtccccgcccaggagaagaacttcaccaccgcccccgcgatctgcaacgacgggaaggcccacttcccccgcgagggcgtgttcgtgtccaacgggaccaactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcgggagcggctacatccccgaggccccgcgcgacgggcaggcctacgtgcggaaggacggcgagtgggtcctgctcagcaccttcctgtga

SEQ ID NO: 11882 - RNA, 3726 nt, synthetic construct
  misc_feature 1..3726: note = SARS-CoV-2/Wuhan/WIV05/2019__EPI_ISL_402128 spike protein CDS gc (1-1211)(I712C_T1077C) Foldon construct
  source 1..3726: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagctgcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcacctgcgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcgggagcggctacatccccgaggccccgcgcgacgggcaggcctacgtgcggaaggacggcgagtgggtcctgctcagcaccttcctgtga

SEQ ID NO: 11883 - RNA, 3726 nt, synthetic construct
  misc_feature 1..3726: note = SARS-CoV-2/Wuhan/WIV05/2019__EPI_ISL_402128 spike protein CDS gc (1-1211)(I714C_Y1110C) Foldon construct
  source 1..3726: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgcctgccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctgcgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcgggagcggctacatccccgaggccccgcgcgacgggcaggcctacgtgcggaaggacggcgagtgggtcctgctcagcaccttcctgtga

SEQ ID NO: 11884 - RNA, 3726 nt, synthetic construct
  misc_feature 1..3726: note = SARS-CoV-2/Wuhan/WIV05/2019__EPI_ISL_402128 spike protein CDS gc (1-1211)(P715C_P1069C) Foldon construct
  source 1..3726: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatctgcaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtctgcgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcgggagcggctacatccccgaggccccgcgcgacgggcaggcctacgtgcggaaggacggcgagtgggtcctgctcagcaccttcctgtga

SEQ ID NO: 11885 - RNA, 3726 nt, synthetic construct
  misc_feature 1..3726: note = SARS-CoV-2/Wuhan/WIV05/2019__EPI_ISL_402128 spike protein CDS gc (1-1211)(G889C_L1034C) Foldon construct
  source 1..3726: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttctgcgccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtctgcggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcgggagcggctacatccccgaggccccgcgcgacgggcaggcctacgtgcggaaggacggcgagtgggtcctgctcagcaccttcctgtga

SEQ ID NO: 11886 - RNA, 3726 nt, synthetic construct
  misc_feature 1..3726: note = SARS-CoV-2/Wuhan/WIV05/2019__EPI_ISL_402128 spike protein CDS gc (1-1211)(I909C_Y1047C) Foldon construct
  source 1..3726: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggctgcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtgccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcgggagcggctacatccccgaggccccgcgcgacgggcaggcctacgtgcggaaggacggcgagtgggtcctgctcagcaccttcctgtga

SEQ ID NO: 11887 - RNA, 3726 nt, synthetic construct
  misc_feature 1..3726: note = SARS-CoV-2/Wuhan/WIV05/2019__EPI_ISL_402128 spike protein CDS gc (1-1211)(Q965C_S1003C) Foldon construct
  source 1..3726: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagtgcctgtccagcaacttcggcgccatctccagcgtgctgaacgacatcctctcccgcctggacaaggtcgaggccgaggtgcagatcgaccggctgatcaccgggcgcctccagtgcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcgggagcggctacatccccgaggccccgcgcgacgggcaggcctacgtgcggaaggacggcgagtgggtcctgctcagcaccttcctgtga

SEQ ID NO: 11888 - RNA, 3726 nt, synthetic construct
  misc_feature 1..3726: note = SARS-CoV-2/Wuhan/WIV05/2019__EPI_ISL_402128 spike protein CDS gc (1-1211)(F970C_G999C) Foldon construct
  source 1..3726: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaactgcggcgccatctccagcgtgctgaacgacatcctctcccgcctggacaaggtcgaggccgaggtgcagatcgaccggctgatcacctgtcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcgggagcggctacatccccgaggccccgcgcgacgggcaggcctacgtgcggaaggacggcgagtgggtcctgctcagcaccttcctgtga

SEQ ID NO: 11889 - RNA, 3726 nt, synthetic construct
  misc_feature 1..3726: note = SARS-CoV-2/Wuhan/WIV05/2019__EPI_ISL_402128 spike protein CDS gc (1-1211)(A972C_R995C) Foldon construct
  source 1..3726: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggctgcatctccagcgtgctgaacgacatcctctcccgcctggacaaggtcgaggccgaggtgcagatcgactgcctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcgggagcggctacatccccgaggccccgcgcgacgggcaggcctacgtgcggaaggacggcgagtgggtcctgctcagcaccttcctgtga

SEQ ID NO: 11890 - RNA, 3726 nt, synthetic construct
  misc_feature 1..3726: note = SARS-CoV-2/Wuhan/WIV05/2019__EPI_ISL_402128 spike protein CDS gc (1-1211)(A890C_V1040C) Foldon construct
  source 1..3726: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcgggtgcggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcggtgcgacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcgggagcggctacatccccgaggccccgcgcgacgggcaggcctacgtgcggaaggacggcgagtgggtcctgctcagcaccttcctgtga

SEQ ID NO: 11891 - RNA, 3726 nt, synthetic construct
  misc_feature 1..3726: note = SARS-CoV-2/Wuhan/WIV05/2019__EPI_ISL_402128 spike protein CDS gc (1-1211)(T874C_S1055C) Foldon construct
  source 1..3726: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtactgcagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagtgcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcgggagcggctacatccccgaggccccgcgcgacgggcaggcctacgtgcggaaggacggcgagtgggtcctgctcagcaccttcctgtga

SEQ ID NO: 11892 - RNA, 4098 nt, synthetic construct
  misc_feature 1..4098: note = SARS-CoV-2/Wuhan/WIV05/2019__EPI_ISL_402128 spike protein CDS gc (1-1211) WhcAg construct
  source 1..4098: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcgggggcgggagcgacatcgacccctacaaggagttcggcagctcctaccagctgctcaacttcctgcccctggacttcttccccgacctcaacgccctggtggacaccgccaccgcgctgtacgaggaggagctcacggggcgcgagcactgcagcccccaccacaccgccatccggcaggccctggtctgctgggacgagctgaccaagctcatcgcctggatgtccagcaacatcacctccgagcaggtccgcacgatcatcgtgaaccacgtcaacgacacctggggcctgaaggtgcggcagagcctgtggttccacctctcctgcctgaccttcgggcagcacaccgtgcaggagttcctggtcagcttcggcgtgtggatccgcacgcccgccccgtaccggccgcccaacgcgccgatcctctccaccctgccggagcacaccgtgatctgctga

SEQ ID NO: 11893 - RNA, 4098 nt, synthetic construct
  misc_feature 1..4098: note = SARS-CoV-2/Wuhan/WIV05/2019__EPI_ISL_402128 spike protein CDS gc (1-1211)(K986P_V987P) WhcAg construct
  source 1..4098: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcgggggcgggagcgacatcgacccctacaaggagttcggcagctcctaccagctgctcaacttcctgcccctggacttcttccccgacctcaacgccctggtggacaccgccaccgcgctgtacgaggaggagctcacggggcgcgagcactgcagcccccaccacaccgccatccggcaggccctggtctgctgggacgagctgaccaagctcatcgcctggatgtccagcaacatcacctccgagcaggtccgcacgatcatcgtgaaccacgtcaacgacacctggggcctgaaggtgcggcagagcctgtggttccacctctcctgcctgaccttcgggcagcacaccgtgcaggagttcctggtcagcttcggcgtgtggatccgcacgcccgccccgtaccggccgcccaacgcgccgatcctctccaccctgccggagcacaccgtgatctgctga

SEQ ID NO: 11894 - RNA, 4098 nt, synthetic construct
  misc_feature 1..4098: note = SARS-CoV-2/Wuhan/WIV05/2019__EPI_ISL_402128 spike protein CDS gc (1-1211)(K986P_V987P_T887WN_A1020W) WhcAg construct
  source 1..4098: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggtggttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgctggagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcgggggcgggagcgacatcgacccctacaaggagttcggcagctcctaccagctgctcaacttcctgcccctggacttcttccccgacctcaacgccctggtggacaccgccaccgcgctgtacgaggaggagctcacggggcgcgagcactgcagcccccaccacaccgccatccggcaggccctggtctgctgggacgagctgaccaagctcatcgcctggatgtccagcaacatcacctccgagcaggtccgcacgatcatcgtgaaccacgtcaacgacacctggggcctgaaggtgcggcagagcctgtggttccacctctcctgcctgaccttcgggcagcacaccgtgcaggagttcctggtcagcttcggcgtgtggatccgcacgcccgccccgtaccggccgcccaacgcgccgatcctctccaccctgccggagcacaccgtgatctgctga

SEQ ID NO: 11895 - RNA, 4098 nt, synthetic construct
  misc_feature 1..4098: note = SARS-CoV-2/Wuhan/WIV05/2019__EPI_ISL_402128 spike protein CDS gc (1-1211)(K986P_V987P_P1069F) WhcAg construct
  source 1..4098: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtcttcgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcgggggcgggagcgacatcgacccctacaaggagttcggcagctcctaccagctgctcaacttcctgcccctggacttcttccccgacctcaacgccctggtggacaccgccaccgcgctgtacgaggaggagctcacggggcgcgagcactgcagcccccaccacaccgccatccggcaggccctggtctgctgggacgagctgaccaagctcatcgcctggatgtccagcaacatcacctccgagcaggtccgcacgatcatcgtgaaccacgtcaacgacacctggggcctgaaggtgcggcagagcctgtggttccacctctcctgcctgaccttcgggcagcacaccgtgcaggagttcctggtcagcttcggcgtgtggatccgcacgcccgccccgtaccggccgcccaacgcgccgatcctctccaccctgccggagcacaccgtgatctgctga

SEQ ID NO: 11896 - RNA, 4098 nt, synthetic construct
  misc_feature 1..4098: note = SARS-CoV-2/Wuhan/WIV05/2019__EPI_ISL_402128 spike protein CDS gc (1-1211)(K986P_V987P_ H1048Q_H1064N_ H1083N_H1101N) WhcAg construct
  source 1..4098: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccagctgatgtccttcccccagagcgccccgcacggcgtggtcttcctcaacgtgacgtacgtccccgcccaggagaagaacttcaccaccgcccccgcgatctgcaacgacgggaaggcccacttcccccgcgagggcgtgttcgtgtccaacgggaccaactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcgggggcgggagcgacatcgacccctacaaggagttcggcagctcctaccagctgctcaacttcctgcccctggacttcttccccgacctcaacgccctggtggacaccgccaccgcgctgtacgaggaggagctcacggggcgcgagcactgcagcccccaccacaccgccatccggcaggccctggtctgctgggacgagctgaccaagctcatcgcctggatgtccagcaacatcacctccgagcaggtccgcacgatcatcgtgaaccacgtcaacgacacctggggcctgaaggtgcggcagagcctgtggttccacctctcctgcctgaccttcgggcagcacaccgtgcaggagttcctggtcagcttcggcgtgtggatccgcacgcccgccccgtaccggccgcccaacgcgccgatcctctccaccctgccggagcacaccgtgatctgctga

SEQ ID NO: 11897 - RNA, 4098 nt, synthetic construct
  misc_feature 1..4098: note = SARS-CoV-2/Wuhan/WIV05/2019__EPI_ISL_402128 spike protein CDS gc (1-1211)(I712C_T1077C) WhcAg construct
  source 1..4098: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagctgcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcacctgcgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcgggggcgggagcgacatcgacccctacaaggagttcggcagctcctaccagctgctcaacttcctgcccctggacttcttccccgacctcaacgccctggtggacaccgccaccgcgctgtacgaggaggagctcacggggcgcgagcactgcagcccccaccacaccgccatccggcaggccctggtctgctgggacgagctgaccaagctcatcgcctggatgtccagcaacatcacctccgagcaggtccgcacgatcatcgtgaaccacgtcaacgacacctggggcctgaaggtgcggcagagcctgtggttccacctctcctgcctgaccttcgggcagcacaccgtgcaggagttcctggtcagcttcggcgtgtggatccgcacgcccgccccgtaccggccgcccaacgcgccgatcctctccaccctgccggagcacaccgtgatctgctga

SEQ ID NO: 11898 - RNA, 4098 nt, synthetic construct
  misc_feature 1..4098: note = SARS-CoV-2/Wuhan/WIV05/2019__EPI_ISL_402128 spike protein CDS gc (1-1211)(I714C_Y1110C) WhcAg construct
  source 1..4098: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgcctgccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctgcgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcgggggcgggagcgacatcgacccctacaaggagttcggcagctcctaccagctgctcaacttcctgcccctggacttcttccccgacctcaacgccctggtggacaccgccaccgcgctgtacgaggaggagctcacggggcgcgagcactgcagcccccaccacaccgccatccggcaggccctggtctgctgggacgagctgaccaagctcatcgcctggatgtccagcaacatcacctccgagcaggtccgcacgatcatcgtgaaccacgtcaacgacacctggggcctgaaggtgcggcagagcctgtggttccacctctcctgcctgaccttcgggcagcacaccgtgcaggagttcctggtcagcttcggcgtgtggatccgcacgcccgccccgtaccggccgcccaacgcgccgatcctctccaccctgccggagcacaccgtgatctgctga

SEQ ID NO: 11899 - RNA, 4098 nt, synthetic construct
  misc_feature 1..4098: note = SARS-CoV-2/Wuhan/WIV05/2019__EPI_ISL_402128 spike protein CDS gc (1-1211)(P715C_P1069C) WhcAg construct
  source 1..4098: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatctgcaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtctgcgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcgggggcgggagcgacatcgacccctacaaggagttcggcagctcctaccagctgctcaacttcctgcccctggacttcttccccgacctcaacgccctggtggacaccgccaccgcgctgtacgaggaggagctcacggggcgcgagcactgcagcccccaccacaccgccatccggcaggccctggtctgctgggacgagctgaccaagctcatcgcctggatgtccagcaacatcacctccgagcaggtccgcacgatcatcgtgaaccacgtcaacgacacctggggcctgaaggtgcggcagagcctgtggttccacctctcctgcctgaccttcgggcagcacaccgtgcaggagttcctggtcagcttcggcgtgtggatccgcacgcccgccccgtaccggccgcccaacgcgccgatcctctccaccctgccggagcacaccgtgatctgctga

SEQ ID NO: 11900 - RNA, 4098 nt, synthetic construct
  misc_feature 1..4098: note = SARS-CoV-2/Wuhan/WIV05/2019__EPI_ISL_402128 spike protein CDS gc (1-1211)(G889C_L1034C) WhcAg construct
  source 1..4098: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttctgcgccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtctgcggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcgggggcgggagcgacatcgacccctacaaggagttcggcagctcctaccagctgctcaacttcctgcccctggacttcttccccgacctcaacgccctggtggacaccgccaccgcgctgtacgaggaggagctcacggggcgcgagcactgcagcccccaccacaccgccatccggcaggccctggtctgctgggacgagctgaccaagctcatcgcctggatgtccagcaacatcacctccgagcaggtccgcacgatcatcgtgaaccacgtcaacgacacctggggcctgaaggtgcggcagagcctgtggttccacctctcctgcctgaccttcgggcagcacaccgtgcaggagttcctggtcagcttcggcgtgtggatccgcacgcccgccccgtaccggccgcccaacgcgccgatcctctccaccctgccggagcacaccgtgatctgctga

SEQ ID NO: 11901 - RNA, 4098 nt, synthetic construct
  misc_feature 1..4098: note = SARS-CoV-2/Wuhan/WIV05/2019__EPI_ISL_402128 spike protein CDS gc (1-1211)(I909C_Y1047C) WhcAg construct
  source 1..4098: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggctgcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtgccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcgggggcgggagcgacatcgacccctacaaggagttcggcagctcctaccagctgctcaacttcctgcccctggacttcttccccgacctcaacgccctggtggacaccgccaccgcgctgtacgaggaggagctcacggggcgcgagcactgcagcccccaccacaccgccatccggcaggccctggtctgctgggacgagctgaccaagctcatcgcctggatgtccagcaacatcacctccgagcaggtccgcacgatcatcgtgaaccacgtcaacgacacctggggcctgaaggtgcggcagagcctgtggttccacctctcctgcctgaccttcgggcagcacaccgtgcaggagttcctggtcagcttcggcgtgtggatccgcacgcccgccccgtaccggccgcccaacgcgccgatcctctccaccctgccggagcacaccgtgatctgctga

SEQ ID NO: 11902 - RNA, 4098 nt, synthetic construct
  misc_feature 1..4098: note = SARS-CoV-2/Wuhan/WIV05/2019__EPI_ISL_402128 spike protein CDS gc (1-1211)(Q965C_S1003C) WhcAg construct
  source 1..4098: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagtgcctgtccagcaacttcggcgccatctccagcgtgctgaacgacatcctctcccgcctggacaaggtcgaggccgaggtgcagatcgaccggctgatcaccgggcgcctccagtgcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcgggggcgggagcgacatcgacccctacaaggagttcggcagctcctaccagctgctcaacttcctgcccctggacttcttccccgacctcaacgccctggtggacaccgccaccgcgctgtacgaggaggagctcacggggcgcgagcactgcagcccccaccacaccgccatccggcaggccctggtctgctgggacgagctgaccaagctcatcgcctggatgtccagcaacatcacctccgagcaggtccgcacgatcatcgtgaaccacgtcaacgacacctggggcctgaaggtgcggcagagcctgtggttccacctctcctgcctgaccttcgggcagcacaccgtgcaggagttcctggtcagcttcggcgtgtggatccgcacgcccgccccgtaccggccgcccaacgcgccgatcctctccaccctgccggagcacaccgtgatctgctga

SEQ ID NO: 11903 - RNA, 4098 nt, synthetic construct
  misc_feature 1..4098: note = SARS-CoV-2/Wuhan/WIV05/2019__EPI_ISL_402128 spike protein CDS gc (1-1211)(F970C_G999C) WhcAg construct
  source 1..4098: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaactgcggcgccatctccagcgtgctgaacgacatcctctcccgcctggacaaggtcgaggccgaggtgcagatcgaccggctgatcacctgtcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcgggggcgggagcgacatcgacccctacaaggagttcggcagctcctaccagctgctcaacttcctgcccctggacttcttccccgacctcaacgccctggtggacaccgccaccgcgctgtacgaggaggagctcacggggcgcgagcactgcagcccccaccacaccgccatccggcaggccctggtctgctgggacgagctgaccaagctcatcgcctggatgtccagcaacatcacctccgagcaggtccgcacgatcatcgtgaaccacgtcaacgacacctggggcctgaaggtgcggcagagcctgtggttccacctctcctgcctgaccttcgggcagcacaccgtgcaggagttcctggtcagcttcggcgtgtggatccgcacgcccgccccgtaccggccgcccaacgcgccgatcctctccaccctgccggagcacaccgtgatctgctga

SEQ ID NO: 11904 - RNA, 4098 nt, synthetic construct
  misc_feature 1..4098: note = SARS-CoV-2/Wuhan/WIV05/2019__EPI_ISL_402128 spike protein CDS gc (1-1211)(A972C_R995C) WhcAg construct
  source 1..4098: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggctgcatctccagcgtgctgaacgacatcctctcccgcctggacaaggtcgaggccgaggtgcagatcgactgcctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcgggggcgggagcgacatcgacccctacaaggagttcggcagctcctaccagctgctcaacttcctgcccctggacttcttccccgacctcaacgccctggtggacaccgccaccgcgctgtacgaggaggagctcacggggcgcgagcactgcagcccccaccacaccgccatccggcaggccctggtctgctgggacgagctgaccaagctcatcgcctggatgtccagcaacatcacctccgagcaggtccgcacgatcatcgtgaaccacgtcaacgacacctggggcctgaaggtgcggcagagcctgtggttccacctctcctgcctgaccttcgggcagcacaccgtgcaggagttcctggtcagcttcggcgtgtggatccgcacgcccgccccgtaccggccgcccaacgcgccgatcctctccaccctgccggagcacaccgtgatctgctga

SEQ ID NO: 11905 - RNA, 4098 nt, synthetic construct
  misc_feature 1..4098: note = SARS-CoV-2/Wuhan/WIV05/2019__EPI_ISL_402128 spike protein CDS gc (1-1211)(A890C_V1040C) WhcAg construct
  source 1..4098: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcgggtgcggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcggtgcgacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcgggggcgggagcgacatcgacccctacaaggagttcggcagctcctaccagctgctcaacttcctgcccctggacttcttccccgacctcaacgccctggtggacaccgccaccgcgctgtacgaggaggagctcacggggcgcgagcactgcagcccccaccacaccgccatccggcaggccctggtctgctgggacgagctgaccaagctcatcgcctggatgtccagcaacatcacctccgagcaggtccgcacgatcatcgtgaaccacgtcaacgacacctggggcctgaaggtgcggcagagcctgtggttccacctctcctgcctgaccttcgggcagcacaccgtgcaggagttcctggtcagcttcggcgtgtggatccgcacgcccgccccgtaccggccgcccaacgcgccgatcctctccaccctgccggagcacaccgtgatctgctga

SEQ ID NO: 11906 - RNA, 4098 nt, synthetic construct
  misc_feature 1..4098: note = SARS-CoV-2/Wuhan/WIV05/2019__EPI_ISL_402128 spike protein CDS gc (1-1211)(T874C_S1055C) WhcAg construct
  source 1..4098: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtactgcagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagtgcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcgggggcgggagcgacatcgacccctacaaggagttcggcagctcctaccagctgctcaacttcctgcccctggacttcttccccgacctcaacgccctggtggacaccgccaccgcgctgtacgaggaggagctcacggggcgcgagcactgcagcccccaccacaccgccatccggcaggccctggtctgctgggacgagctgaccaagctcatcgcctggatgtccagcaacatcacctccgagcaggtccgcacgatcatcgtgaaccacgtcaacgacacctggggcctgaaggtgcggcagagcctgtggttccacctctcctgcctgaccttcgggcagcacaccgtgcaggagttcctggtcagcttcggcgtgtggatccgcacgcccgccccgtaccggccgcccaacgcgccgatcctctccaccctgccggagcacaccgtgatctgctga

SEQ ID NO: 11907 - RNA, 3924 nt, synthetic construct
  misc_feature 1..3924: note = SARS-CoV-2/Wuhan/WIV05/2019__EPI_ISL_402128 spike protein CDS gc (1-1147) LumSynth construct
  source 1..3924: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcggcgggagcgggggcgggcagatctacgagggcaagctgaccgccgaggggctccgcttcggcatcgtggccagccggttcaaccacgcgctggtcgaccgcctggtggagggggccatcgacgccatcgtgcggcacggcgggcgcgaggaggacatcaccctcgtccgggtgcccggctcctgggagatcccggtggccgccggcgagctggcccgcaaggaggacatcgacgcggtcatcgccatcggggtgctgatccggggcgccacgccccacttcgactacatcgccagcgaggtgtccaaggggctcgcggacctgagcctggagctccgcaagcccatcaccttcggcgtcatcaccgccgacaccctggagcaggccatcgagcgggccgggacgaagcacggcaacaagggctgggaggccgcgctgtccgccatcgagatggccaacctcttcaagagcctgcgctga

SEQ ID NO: 11908 - RNA, 3924 nt, synthetic construct
  misc_feature 1..3924: note = SARS-CoV-2/Wuhan/WIV05/2019__EPI_ISL_402128 spike protein CDS gc (1-1147)(K986P_V987P) LumSynth construct
  source 1..3924: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcggcgggagcgggggcgggcagatctacgagggcaagctgaccgccgaggggctccgcttcggcatcgtggccagccggttcaaccacgcgctggtcgaccgcctggtggagggggccatcgacgccatcgtgcggcacggcgggcgcgaggaggacatcaccctcgtccgggtgcccggctcctgggagatcccggtggccgccggcgagctggcccgcaaggaggacatcgacgcggtcatcgccatcggggtgctgatccggggcgccacgccccacttcgactacatcgccagcgaggtgtccaaggggctcgcggacctgagcctggagctccgcaagcccatcaccttcggcgtcatcaccgccgacaccctggagcaggccatcgagcgggccgggacgaagcacggcaacaagggctgggaggccgcgctgtccgccatcgagatggccaacctcttcaagagcctgcgctga

SEQ ID NO: 11909 - RNA, 3924 nt, synthetic construct
  misc_feature 1..3924: note = SARS-CoV-2/Wuhan/WIV05/2019__EPI_ISL_402128 spike protein CDS gc (1-1147)(K986P_V987P_T887WN_A1020W) LumSynth construct
  source 1..3924: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggtggttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgctggagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcggcgggagcgggggcgggcagatctacgagggcaagctgaccgccgaggggctccgcttcggcatcgtggccagccggttcaaccacgcgctggtcgaccgcctggtggagggggccatcgacgccatcgtgcggcacggcgggcgcgaggaggacatcaccctcgtccgggtgcccggctcctgggagatcccggtggccgccggcgagctggcccgcaaggaggacatcgacgcggtcatcgccatcggggtgctgatccggggcgccacgccccacttcgactacatcgccagcgaggtgtccaaggggctcgcggacctgagcctggagctccgcaagcccatcaccttcggcgtcatcaccgccgacaccctggagcaggccatcgagcgggccgggacgaagcacggcaacaagggctgggaggccgcgctgtccgccatcgagatggccaacctcttcaagagcctgcgctga

SEQ ID NO: 11910 - RNA, 3924 nt, synthetic construct
  misc_feature 1..3924: note = SARS-CoV-2/Wuhan/WIV05/2019__EPI_ISL_402128 spike protein CDS gc (1-1147)(K986P_V987P_P1069F) LumSynth construct
  source 1..3924: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtcttcgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcggcgggagcgggggcgggcagatctacgagggcaagctgaccgccgaggggctccgcttcggcatcgtggccagccggttcaaccacgcgctggtcgaccgcctggtggagggggccatcgacgccatcgtgcggcacggcgggcgcgaggaggacatcaccctcgtccgggtgcccggctcctgggagatcccggtggccgccggcgagctggcccgcaaggaggacatcgacgcggtcatcgccatcggggtgctgatccggggcgccacgccccacttcgactacatcgccagcgaggtgtccaaggggctcgcggacctgagcctggagctccgcaagcccatcaccttcggcgtcatcaccgccgacaccctggagcaggccatcgagcgggccgggacgaagcacggcaacaagggctgggaggccgcgctgtccgccatcgagatggccaacctcttcaagagcctgcgctga

SEQ ID NO: 11911 - RNA, 3924 nt, synthetic construct
  misc_feature 1..3924: note = SARS-CoV-2/Wuhan/WIV05/2019__EPI_ISL_402128 spike protein CDS gc (1-1147)(K986P_V987P_ H1048Q_H1064N_ H1083N_H1101N) LumSynth construct
  source 1..3924: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccagctgatgtccttcccccagagcgccccgcacggcgtggtcttcctcaacgtgacgtacgtccccgcccaggagaagaacttcaccaccgcccccgcgatctgcaacgacgggaaggcccacttcccccgcgagggcgtgttcgtgtccaacgggaccaactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcggcgggagcgggggcgggcagatctacgagggcaagctgaccgccgaggggctccgcttcggcatcgtggccagccggttcaaccacgcgctggtcgaccgcctggtggagggggccatcgacgccatcgtgcggcacggcgggcgcgaggaggacatcaccctcgtccgggtgcccggctcctgggagatcccggtggccgccggcgagctggcccgcaaggaggacatcgacgcggtcatcgccatcggggtgctgatccggggcgccacgccccacttcgactacatcgccagcgaggtgtccaaggggctcgcggacctgagcctggagctccgcaagcccatcaccttcggcgtcatcaccgccgacaccctggagcaggccatcgagcgggccgggacgaagcacggcaacaagggctgggaggccgcgctgtccgccatcgagatggccaacctcttcaagagcctgcgctga

SEQ ID NO: 11912 - RNA, 3924 nt, synthetic construct
  misc_feature 1..3924: note = SARS-CoV-2/Wuhan/WIV05/2019__EPI_ISL_402128 spike protein CDS gc (1-1147)(I712C_T1077C) LumSynth construct
  source 1..3924: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagctgcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcacctgcgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcggcgggagcgggggcgggcagatctacgagggcaagctgaccgccgaggggctccgcttcggcatcgtggccagccggttcaaccacgcgctggtcgaccgcctggtggagggggccatcgacgccatcgtgcggcacggcgggcgcgaggaggacatcaccctcgtccgggtgcccggctcctgggagatcccggtggccgccggcgagctggcccgcaaggaggacatcgacgcggtcatcgccatcggggtgctgatccggggcgccacgccccacttcgactacatcgccagcgaggtgtccaaggggctcgcggacctgagcctggagctccgcaagcccatcaccttcggcgtcatcaccgccgacaccctggagcaggccatcgagcgggccgggacgaagcacggcaacaagggctgggaggccgcgctgtccgccatcgagatggccaacctcttcaagagcctgcgctga

SEQ ID NO: 11913 - RNA, 3924 nt, synthetic construct
  misc_feature 1..3924: note = SARS-CoV-2/Wuhan/WIV05/2019__EPI_ISL_402128 spike protein CDS gc (1-1147)(I714C_Y1110C) LumSynth construct
  source 1..3924: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgcctgccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctgcgagccgcagatcatcaccaccgacaacaccttcgtgagcggcaactgcgacgtggtcatcggcatcgtgaacaacacggtgtacgaccccctgcagcccgagctggactccggcggcgggagcgggggcgggcagatctacgagggcaagctgaccgccgaggggctccgcttcggcatcgtggccagccggttcaaccacgcgctggtcgaccgcctggtggagggggccatcgacgccatcgtgcggcacggcgggcgcgaggaggacatcaccctcgtccgggtgcccggctcctgggagatcccggtggccgccggcgagctggcccgcaaggaggacatcgacgcggtcatcgccatcggggtgctgatccggggcgccacgccccacttcgactacatcgccagcgaggtgtccaaggggctcgcggacctgagcctggagctccgcaagcccatcaccttcggcgtcatcaccgccgacaccctggagcaggccatcgagcgggccgggacgaagcacggcaacaagggctgggaggccgcgctgtccgccatcgagatggccaacctcttcaagagcctgcgctga

SEQ ID NO: 11914 - RNA, 3924 nt, synthetic construct
  misc_feature 1..3924: note = SARS-CoV-2/Wuhan/WIV05/2019__EPI_ISL_402128 spike protein CDS gc (1-1147)(P715C_P1069C) LumSynth construct
  source 1..3924: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatctgcaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtctgcgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcggcgggagcgggggcgggcagatctacgagggcaagctgaccgccgaggggctccgcttcggcatcgtggccagccggttcaaccacgcgctggtcgaccgcctggtggagggggccatcgacgccatcgtgcggcacggcgggcgcgaggaggacatcaccctcgtccgggtgcccggctcctgggagatcccggtggccgccggcgagctggcccgcaaggaggacatcgacgcggtcatcgccatcggggtgctgatccggggcgccacgccccacttcgactacatcgccagcgaggtgtccaaggggctcgcggacctgagcctggagctccgcaagcccatcaccttcggcgtcatcaccgccgacaccctggagcaggccatcgagcgggccgggacgaagcacggcaacaagggctgggaggccgcgctgtccgccatcgagatggccaacctcttcaagagcctgcgctga

SEQ ID NO: 11915 - RNA, 3924 nt, synthetic construct
  misc_feature 1..3924: note = SARS-CoV-2/Wuhan/WIV05/2019__EPI_ISL_402128 spike protein CDS gc (1-1147)(G889C_L1034C) LumSynth construct
  source 1..3924: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttctgcgccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtctgcggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcggcgggagcgggggcgggcagatctacgagggcaagctgaccgccgaggggctccgcttcggcatcgtggccagccggttcaaccacgcgctggtcgaccgcctggtggagggggccatcgacgccatcgtgcggcacggcgggcgcgaggaggacatcaccctcgtccgggtgcccggctcctgggagatcccggtggccgccggcgagctggcccgcaaggaggacatcgacgcggtcatcgccatcggggtgctgatccggggcgccacgccccacttcgactacatcgccagcgaggtgtccaaggggctcgcggacctgagcctggagctccgcaagcccatcaccttcggcgtcatcaccgccgacaccctggagcaggccatcgagcgggccgggacgaagcacggcaacaagggctgggaggccgcgctgtccgccatcgagatggccaacctcttcaagagcctgcgctga

SEQ ID NO: 11916 - RNA, 3924 nt, synthetic construct
  misc_feature 1..3924: note = SARS-CoV-2/Wuhan/WIV05/2019__EPI_ISL_402128 spike protein CDS gc (1-1147)(I909C_Y1047C) LumSynth construct
  source 1..3924: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggctgcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtgccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcggcgggagcgggggcgggcagatctacgagggcaagctgaccgccgaggggctccgcttcggcatcgtggccagccggttcaaccacgcgctggtcgaccgcctggtggagggggccatcgacgccatcgtgcggcacggcgggcgcgaggaggacatcaccctcgtccgggtgcccggctcctgggagatcccggtggccgccggcgagctggcccgcaaggaggacatcgacgcggtcatcgccatcggggtgctgatccggggcgccacgccccacttcgactacatcgccagcgaggtgtccaaggggctcgcggacctgagcctggagctccgcaagcccatcaccttcggcgtcatcaccgccgacaccctggagcaggccatcgagcgggccgggacgaagcacggcaacaagggctgggaggccgcgctgtccgccatcgagatggccaacctcttcaagagcctgcgctga

SEQ ID NO: 11917 - RNA, 3924 nt, synthetic construct
  misc_feature 1..3924: note = SARS-CoV-2/Wuhan/WIV05/2019__EPI_ISL_402128 spike protein CDS gc (1-1147)(Q965C_S1003C) LumSynth construct
  source 1..3924: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagtgcctgtccagcaacttcggcgccatctccagcgtgctgaacgacatcctctcccgcctggacaaggtcgaggccgaggtgcagatcgaccggctgatcaccgggcgcctccagtgcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcggcgggagcgggggcgggcagatctacgagggcaagctgaccgccgaggggctccgcttcggcatcgtggccagccggttcaaccacgcgctggtcgaccgcctggtggagggggccatcgacgccatcgtgcggcacggcgggcgcgaggaggacatcaccctcgtccgggtgcccggctcctgggagatcccggtggccgccggcgagctggcccgcaaggaggacatcgacgcggtcatcgccatcggggtgctgatccggggcgccacgccccacttcgactacatcgccagcgaggtgtccaaggggctcgcggacctgagcctggagctccgcaagcccatcaccttcggcgtcatcaccgccgacaccctggagcaggccatcgagcgggccgggacgaagcacggcaacaagggctgggaggccgcgctgtccgccatcgagatggccaacctcttcaagagcctgcgctga

SEQ ID NO: 11918 - RNA, 3924 nt, synthetic construct
  misc_feature 1..3924: note = SARS-CoV-2/Wuhan/WIV05/2019__EPI_ISL_402128 spike protein CDS gc (1-1147)(F970C_G999C) LumSynth construct
  source 1..3924: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaactgcggcgccatctccagcgtgctgaacgacatcctctcccgcctggacaaggtcgaggccgaggtgcagatcgaccggctgatcacctgtcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcggcgggagcgggggcgggcagatctacgagggcaagctgaccgccgaggggctccgcttcggcatcgtggccagccggttcaaccacgcgctggtcgaccgcctggtggagggggccatcgacgccatcgtgcggcacggcgggcgcgaggaggacatcaccctcgtccgggtgcccggctcctgggagatcccggtggccgccggcgagctggcccgcaaggaggacatcgacgcggtcatcgccatcggggtgctgatccggggcgccacgccccacttcgactacatcgccagcgaggtgtccaaggggctcgcggacctgagcctggagctccgcaagcccatcaccttcggcgtcatcaccgccgacaccctggagcaggccatcgagcgggccgggacgaagcacggcaacaagggctgggaggccgcgctgtccgccatcgagatggccaacctcttcaagagcctgcgctga

SEQ ID NO: 11919 - RNA, 3924 nt, synthetic construct
  misc_feature 1..3924: note = SARS-CoV-2/Wuhan/WIV05/2019__EPI_ISL_402128 spike protein CDS gc (1-1147)(A972C_R995C) LumSynth construct
  source 1..3924: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggctgcatctccagcgtgctgaacgacatcctctcccgcctggacaaggtcgaggccgaggtgcagatcgactgcctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcggcgggagcgggggcgggcagatctacgagggcaagctgaccgccgaggggctccgcttcggcatcgtggccagccggttcaaccacgcgctggtcgaccgcctggtggagggggccatcgacgccatcgtgcggcacggcgggcgcgaggaggacatcaccctcgtccgggtgcccggctcctgggagatcccggtggccgccggcgagctggcccgcaaggaggacatcgacgcggtcatcgccatcggggtgctgatccggggcgccacgccccacttcgactacatcgccagcgaggtgtccaaggggctcgcggacctgagcctggagctccgcaagcccatcaccttcggcgtcatcaccgccgacaccctggagcaggccatcgagcgggccgggacgaagcacggcaacaagggctgggaggccgcgctgtccgccatcgagatggccaacctcttcaagagcctgcgctga

SEQ ID NO: 11920 - RNA, 3924 nt, synthetic construct
  misc_feature 1..3924: note = SARS-CoV-2/Wuhan/WIV05/2019__EPI_ISL_402128 spike protein CDS gc (1-1147)(A890C_V1040C) LumSynth construct
  source 1..3924: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcgggtgcggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcggtgcgacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcggcgggagcgggggcgggcagatctacgagggcaagctgaccgccgaggggctccgcttcggcatcgtggccagccggttcaaccacgcgctggtcgaccgcctggtggagggggccatcgacgccatcgtgcggcacggcgggcgcgaggaggacatcaccctcgtccgggtgcccggctcctgggagatcccggtggccgccggcgagctggcccgcaaggaggacatcgacgcggtcatcgccatcggggtgctgatccggggcgccacgccccacttcgactacatcgccagcgaggtgtccaaggggctcgcggacctgagcctggagctccgcaagcccatcaccttcggcgtcatcaccgccgacaccctggagcaggccatcgagcgggccgggacgaagcacggcaacaagggctgggaggccgcgctgtccgccatcgagatggccaacctcttcaagagcctgcgctga

SEQ ID NO: 11921 - RNA, 3924 nt, synthetic construct
  misc_feature 1..3924: note = SARS-CoV-2/Wuhan/WIV05/2019__EPI_ISL_402128 spike protein CDS gc (1-1147)(T874C_S1055C) LumSynth construct
  source 1..3924: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtactgcagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagtgcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcggcgggagcgggggcgggcagatctacgagggcaagctgaccgccgaggggctccgcttcggcatcgtggccagccggttcaaccacgcgctggtcgaccgcctggtggagggggccatcgacgccatcgtgcggcacggcgggcgcgaggaggacatcaccctcgtccgggtgcccggctcctgggagatcccggtggccgccggcgagctggcccgcaaggaggacatcgacgcggtcatcgccatcggggtgctgatccggggcgccacgccccacttcgactacatcgccagcgaggtgtccaaggggctcgcggacctgagcctggagctccgcaagcccatcaccttcggcgtcatcaccgccgacaccctggagcaggccatcgagcgggccgggacgaagcacggcaacaagggctgggaggccgcgctgtccgccatcgagatggccaacctcttcaagagcctgcgctga

SEQ ID NO: 11922 - RNA, 3948 nt, synthetic construct
  misc_feature 1..3948: note = SARS-CoV-2/Wuhan/WIV05/2019__EPI_ISL_402128 spike protein CDS gc (1-1147) Ferritin construct
  source 1..3948: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcgggggcgggagcgacatcatcaagctcctgaacgagcaggtcaacaaggagatgcagtccagcaacctgtacatgtccatgagctcctggtgctacacccacagcctcgacggcgccgggctgttcctgttcgaccacgccgcggaggagtacgagcacgccaagaagctcatcatcttcctgaacgagaacaacgtgcccgtgcagctgacctccatcagcgccccggagcacaagttcgagggcctcacgcagatcttccagaaggcctacgagcacgagcagcacatctccgagagcatcaacaacatcgtggaccacgccatcaagtccaaggaccacgcgaccttcaacttcctgcagtggtacgtcgccgagcagcacgaggaggaggtgctgttcaaggacatcctcgacaagatcgagctgatcgggaacgagaaccacggcctgtacctcgccgaccagtacgtgaaggggatcgccaagagccgcaagtcctga

SEQ ID NO: 11923 - RNA, 3948 nt, synthetic construct
  misc_feature 1..3948: note = SARS-CoV-2/Wuhan/WIV05/2019__EPI_ISL_402128 spike protein CDS gc (1-1147)(K986P_V987P) Ferritin construct
  source 1..3948: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcgggggcgggagcgacatcatcaagctcctgaacgagcaggtcaacaaggagatgcagtccagcaacctgtacatgtccatgagctcctggtgctacacccacagcctcgacggcgccgggctgttcctgttcgaccacgccgcggaggagtacgagcacgccaagaagctcatcatcttcctgaacgagaacaacgtgcccgtgcagctgacctccatcagcgccccggagcacaagttcgagggcctcacgcagatcttccagaaggcctacgagcacgagcagcacatctccgagagcatcaacaacatcgtggaccacgccatcaagtccaaggaccacgcgaccttcaacttcctgcagtggtacgtcgccgagcagcacgaggaggaggtgctgttcaaggacatcctcgacaagatcgagctgatcgggaacgagaaccacggcctgtacctcgccgaccagtacgtgaaggggatcgccaagagccgcaagtcctga

SEQ ID NO: 11924 - RNA, 3948 nt, synthetic construct
  misc_feature 1..3948: note = SARS-CoV-2/Wuhan/WIV05/2019__EPI_ISL_402128 spike protein CDS gc (1-1147)(K986P_V987P_T887WN_A1020W) Ferritin construct
  source 1..3948: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggtggttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgctggagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcgggggcgggagcgacatcatcaagctcctgaacgagcaggtcaacaaggagatgcagtccagcaacctgtacatgtccatgagctcctggtgctacacccacagcctcgacggcgccgggctgttcctgttcgaccacgccgcggaggagtacgagcacgccaagaagctcatcatcttcctgaacgagaacaacgtgcccgtgcagctgacctccatcagcgccccggagcacaagttcgagggcctcacgcagatcttccagaaggcctacgagcacgagcagcacatctccgagagcatcaacaacatcgtggaccacgccatcaagtccaaggaccacgcgaccttcaacttcctgcagtggtacgtcgccgagcagcacgaggaggaggtgctgttcaaggacatcctcgacaagatcgagctgatcgggaacgagaaccacggcctgtacctcgccgaccagtacgtgaaggggatcgccaagagccgcaagtcctga

SEQ ID NO: 11925 - RNA, 3948 nt, synthetic construct
  misc_feature 1..3948: note = SARS-CoV-2/Wuhan/WIV05/2019__EPI_ISL_402128 spike protein CDS gc (1-1147)(K986P_V987P_P1069F) Ferritin construct
  source 1..3948: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtcttcgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcgggggcgggagcgacatcatcaagctcctgaacgagcaggtcaacaaggagatgcagtccagcaacctgtacatgtccatgagctcctggtgctacacccacagcctcgacggcgccgggctgttcctgttcgaccacgccgcggaggagtacgagcacgccaagaagctcatcatcttcctgaacgagaacaacgtgcccgtgcagctgacctccatcagcgccccggagcacaagttcgagggcctcacgcagatcttccagaaggcctacgagcacgagcagcacatctccgagagcatcaacaacatcgtggaccacgccatcaagtccaaggaccacgcgaccttcaacttcctgcagtggtacgtcgccgagcagcacgaggaggaggtgctgttcaaggacatcctcgacaagatcgagctgatcgggaacgagaaccacggcctgtacctcgccgaccagtacgtgaaggggatcgccaagagccgcaagtcctga

SEQ ID NO: 11926 - RNA, 3948 nt, synthetic construct
  misc_feature 1..3948: note = SARS-CoV-2/Wuhan/WIV05/2019__EPI_ISL_402128 spike protein CDS gc (1-1147)(K986P_V987P_ H1048Q_H1064N_ H1083N_H1101N) Ferritin construct
  source 1..3948: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccagctgatgtccttcccccagagcgccccgcacggcgtggtcttcctcaacgtgacgtacgtccccgcccaggagaagaacttcaccaccgcccccgcgatctgcaacgacgggaaggcccacttcccccgcgagggcgtgttcgtgtccaacgggaccaactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcgggggcgggagcgacatcatcaagctcctgaacgagcaggtcaacaaggagatgcagtccagcaacctgtacatgtccatgagctcctggtgctacacccacagcctcgacggcgccgggctgttcctgttcgaccacgccgcggaggagtacgagcacgccaagaagctcatcatcttcctgaacgagaacaacgtgcccgtgcagctgacctccatcagcgccccggagcacaagttcgagggcctcacgcagatcttccagaaggcctacgagcacgagcagcacatctccgagagcatcaacaacatcgtggaccacgccatcaagtccaaggaccacgcgaccttcaacttcctgcagtggtacgtcgccgagcagcacgaggaggaggtgctgttcaaggacatcctcgacaagatcgagctgatcgggaacgagaaccacggcctgtacctcgccgaccagtacgtgaaggggatcgccaagagccgcaagtcctga

SEQ ID NO: 11927 - RNA, 3948 nt, synthetic construct
  misc_feature 1..3948: note = SARS-CoV-2/Wuhan/WIV05/2019__EPI_ISL_402128 spike protein CDS gc (1-1147)(I712C_T1077C) Ferritin construct
  source 1..3948: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagctgcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcacctgcgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcgggggcgggagcgacatcatcaagctcctgaacgagcaggtcaacaaggagatgcagtccagcaacctgtacatgtccatgagctcctggtgctacacccacagcctcgacggcgccgggctgttcctgttcgaccacgccgcggaggagtacgagcacgccaagaagctcatcatcttcctgaacgagaacaacgtgcccgtgcagctgacctccatcagcgccccggagcacaagttcgagggcctcacgcagatcttccagaaggcctacgagcacgagcagcacatctccgagagcatcaacaacatcgtggaccacgccatcaagtccaaggaccacgcgaccttcaacttcctgcagtggtacgtcgccgagcagcacgaggaggaggtgctgttcaaggacatcctcgacaagatcgagctgatcgggaacgagaaccacggcctgtacctcgccgaccagtacgtgaaggggatcgccaagagccgcaagtcctga

SEQ ID NO: 11928 - RNA, 3948 nt, synthetic construct
  misc_feature 1..3948: note = SARS-CoV-2/Wuhan/WIV05/2019__EPI_ISL_402128 spike protein CDS gc (1-1147)(I714C_Y1110C) Ferritin construct
  source 1..3948: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgcctgccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctgcgagccgcagatcatcaccaccgacaacaccttcgtgagcggcaactgcgacgtggtcatcggcatcgtgaacaacacggtgtacgaccccctgcagcccgagctggactccggcgggggcgggagcgacatcatcaagctcctgaacgagcaggtcaacaaggagatgcagtccagcaacctgtacatgtccatgagctcctggtgctacacccacagcctcgacggcgccgggctgttcctgttcgaccacgccgcggaggagtacgagcacgccaagaagctcatcatcttcctgaacgagaacaacgtgcccgtgcagctgacctccatcagcgccccggagcacaagttcgagggcctcacgcagatcttccagaaggcctacgagcacgagcagcacatctccgagagcatcaacaacatcgtggaccacgccatcaagtccaaggaccacgcgaccttcaacttcctgcagtggtacgtcgccgagcagcacgaggaggaggtgctgttcaaggacatcctcgacaagatcgagctgatcgggaacgagaaccacggcctgtacctcgccgaccagtacgtgaaggggatcgccaagagccgcaagtcctga

SEQ ID NO: 11929 - RNA, 3948 nt, synthetic construct
  misc_feature 1..3948: note = SARS-CoV-2/Wuhan/WIV05/2019__EPI_ISL_402128 spike protein CDS gc (1-1147)(P715C_P1069C) Ferritin construct
  source 1..3948: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatctgcaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtctgcgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcgggggcgggagcgacatcatcaagctcctgaacgagcaggtcaacaaggagatgcagtccagcaacctgtacatgtccatgagctcctggtgctacacccacagcctcgacggcgccgggctgttcctgttcgaccacgccgcggaggagtacgagcacgccaagaagctcatcatcttcctgaacgagaacaacgtgcccgtgcagctgacctccatcagcgccccggagcacaagttcgagggcctcacgcagatcttccagaaggcctacgagcacgagcagcacatctccgagagcatcaacaacatcgtggaccacgccatcaagtccaaggaccacgcgaccttcaacttcctgcagtggtacgtcgccgagcagcacgaggaggaggtgctgttcaaggacatcctcgacaagatcgagctgatcgggaacgagaaccacggcctgtacctcgccgaccagtacgtgaaggggatcgccaagagccgcaagtcctga

SEQ ID NO: 11930 - RNA, 3948 nt, synthetic construct
  misc_feature 1..3948: note = SARS-CoV-2/Wuhan/WIV05/2019__EPI_ISL_402128 spike protein CDS gc (1-1147)(G889C_L1034C) Ferritin construct
  source 1..3948: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttctgcgccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtctgcggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcgggggcgggagcgacatcatcaagctcctgaacgagcaggtcaacaaggagatgcagtccagcaacctgtacatgtccatgagctcctggtgctacacccacagcctcgacggcgccgggctgttcctgttcgaccacgccgcggaggagtacgagcacgccaagaagctcatcatcttcctgaacgagaacaacgtgcccgtgcagctgacctccatcagcgccccggagcacaagttcgagggcctcacgcagatcttccagaaggcctacgagcacgagcagcacatctccgagagcatcaacaacatcgtggaccacgccatcaagtccaaggaccacgcgaccttcaacttcctgcagtggtacgtcgccgagcagcacgaggaggaggtgctgttcaaggacatcctcgacaagatcgagctgatcgggaacgagaaccacggcctgtacctcgccgaccagtacgtgaaggggatcgccaagagccgcaagtcctga

SEQ ID NO: 11931 - RNA, 3948 nt, synthetic construct
  misc_feature 1..3948: note = SARS-CoV-2/Wuhan/WIV05/2019__EPI_ISL_402128 spike protein CDS gc (1-1147)(I909C_Y1047C) Ferritin construct
  source 1..3948: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggctgcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtgccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcgggggcgggagcgacatcatcaagctcctgaacgagcaggtcaacaaggagatgcagtccagcaacctgtacatgtccatgagctcctggtgctacacccacagcctcgacggcgccgggctgttcctgttcgaccacgccgcggaggagtacgagcacgccaagaagctcatcatcttcctgaacgagaacaacgtgcccgtgcagctgacctccatcagcgccccggagcacaagttcgagggcctcacgcagatcttccagaaggcctacgagcacgagcagcacatctccgagagcatcaacaacatcgtggaccacgccatcaagtccaaggaccacgcgaccttcaacttcctgcagtggtacgtcgccgagcagcacgaggaggaggtgctgttcaaggacatcctcgacaagatcgagctgatcgggaacgagaaccacggcctgtacctcgccgaccagtacgtgaaggggatcgccaagagccgcaagtcctga

SEQ ID NO: 11932 - RNA, 3948 nt, synthetic construct
  misc_feature 1..3948: note = SARS-CoV-2/Wuhan/WIV05/2019__EPI_ISL_402128 spike protein CDS gc (1-1147)(Q965C_S1003C) Ferritin construct
  source 1..3948: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagtgcctgtccagcaacttcggcgccatctccagcgtgctgaacgacatcctctcccgcctggacaaggtcgaggccgaggtgcagatcgaccggctgatcaccgggcgcctccagtgcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcgggggcgggagcgacatcatcaagctcctgaacgagcaggtcaacaaggagatgcagtccagcaacctgtacatgtccatgagctcctggtgctacacccacagcctcgacggcgccgggctgttcctgttcgaccacgccgcggaggagtacgagcacgccaagaagctcatcatcttcctgaacgagaacaacgtgcccgtgcagctgacctccatcagcgccccggagcacaagttcgagggcctcacgcagatcttccagaaggcctacgagcacgagcagcacatctccgagagcatcaacaacatcgtggaccacgccatcaagtccaaggaccacgcgaccttcaacttcctgcagtggtacgtcgccgagcagcacgaggaggaggtgctgttcaaggacatcctcgacaagatcgagctgatcgggaacgagaaccacggcctgtacctcgccgaccagtacgtgaaggggatcgccaagagccgcaagtcctga

SEQ ID NO: 11933 - RNA, 3948 nt, synthetic construct
  misc_feature 1..3948: note = SARS-CoV-2/Wuhan/WIV05/2019__EPI_ISL_402128 spike protein CDS gc (1-1147)(F970C_G999C) Ferritin construct
  source 1..3948: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaactgcggcgccatctccagcgtgctgaacgacatcctctcccgcctggacaaggtcgaggccgaggtgcagatcgaccggctgatcacctgtcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcgggggcgggagcgacatcatcaagctcctgaacgagcaggtcaacaaggagatgcagtccagcaacctgtacatgtccatgagctcctggtgctacacccacagcctcgacggcgccgggctgttcctgttcgaccacgccgcggaggagtacgagcacgccaagaagctcatcatcttcctgaacgagaacaacgtgcccgtgcagctgacctccatcagcgccccggagcacaagttcgagggcctcacgcagatcttccagaaggcctacgagcacgagcagcacatctccgagagcatcaacaacatcgtggaccacgccatcaagtccaaggaccacgcgaccttcaacttcctgcagtggtacgtcgccgagcagcacgaggaggaggtgctgttcaaggacatcctcgacaagatcgagctgatcgggaacgagaaccacggcctgtacctcgccgaccagtacgtgaaggggatcgccaagagccgcaagtcctga

SEQ ID NO: 11934 - RNA, 3948 nt, synthetic construct
  misc_feature 1..3948: note = SARS-CoV-2/Wuhan/WIV05/2019__EPI_ISL_402128 spike protein CDS gc (1-1147)(A972C_R995C) Ferritin construct
  source 1..3948: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggctgcatctccagcgtgctgaacgacatcctctcccgcctggacaaggtcgaggccgaggtgcagatcgactgcctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcgggggcgggagcgacatcatcaagctcctgaacgagcaggtcaacaaggagatgcagtccagcaacctgtacatgtccatgagctcctggtgctacacccacagcctcgacggcgccgggctgttcctgttcgaccacgccgcggaggagtacgagcacgccaagaagctcatcatcttcctgaacgagaacaacgtgcccgtgcagctgacctccatcagcgccccggagcacaagttcgagggcctcacgcagatcttccagaaggcctacgagcacgagcagcacatctccgagagcatcaacaacatcgtggaccacgccatcaagtccaaggaccacgcgaccttcaacttcctgcagtggtacgtcgccgagcagcacgaggaggaggtgctgttcaaggacatcctcgacaagatcgagctgatcgggaacgagaaccacggcctgtacctcgccgaccagtacgtgaaggggatcgccaagagccgcaagtcctga

SEQ ID NO: 11935 - RNA, 3948 nt, synthetic construct
  misc_feature 1..3948: note = SARS-CoV-2/Wuhan/WIV05/2019__EPI_ISL_402128 spike protein CDS gc (1-1147)(A890C_V1040C) Ferritin construct
  source 1..3948: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcgggtgcggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcggtgcgacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcgggggcgggagcgacatcatcaagctcctgaacgagcaggtcaacaaggagatgcagtccagcaacctgtacatgtccatgagctcctggtgctacacccacagcctcgacggcgccgggctgttcctgttcgaccacgccgcggaggagtacgagcacgccaagaagctcatcatcttcctgaacgagaacaacgtgcccgtgcagctgacctccatcagcgccccggagcacaagttcgagggcctcacgcagatcttccagaaggcctacgagcacgagcagcacatctccgagagcatcaacaacatcgtggaccacgccatcaagtccaaggaccacgcgaccttcaacttcctgcagtggtacgtcgccgagcagcacgaggaggaggtgctgttcaaggacatcctcgacaagatcgagctgatcgggaacgagaaccacggcctgtacctcgccgaccagtacgtgaaggggatcgccaagagccgcaagtcctga

SEQ ID NO: 11936 - RNA, 3948 nt, synthetic construct
  misc_feature 1..3948: note = SARS-CoV-2/Wuhan/WIV05/2019__EPI_ISL_402128 spike protein CDS gc (1-1147)(T874C_S1055C) Ferritin construct
  source 1..3948: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtactgcagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagtgcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcgggggcgggagcgacatcatcaagctcctgaacgagcaggtcaacaaggagatgcagtccagcaacctgtacatgtccatgagctcctggtgctacacccacagcctcgacggcgccgggctgttcctgttcgaccacgccgcggaggagtacgagcacgccaagaagctcatcatcttcctgaacgagaacaacgtgcccgtgcagctgacctccatcagcgccccggagcacaagttcgagggcctcacgcagatcttccagaaggcctacgagcacgagcagcacatctccgagagcatcaacaacatcgtggaccacgccatcaagtccaaggaccacgcgaccttcaacttcctgcagtggtacgtcgccgagcagcacgaggaggaggtgctgttcaaggacatcctcgacaagatcgagctgatcgggaacgagaaccacggcctgtacctcgccgaccagtacgtgaaggggatcgccaagagccgcaagtcctga

SEQ ID NO: 11937 - RNA, 3534 nt, synthetic construct
  misc_feature 1..3534: note = SARS-CoV-2/Wuhan/WIV05/2019__EPI_ISL_402128 spike protein CDS gc (1-1147) Foldon construct
  source 1..3534: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcgggagcggctacatccccgaggccccgcgcgacgggcaggcctacgtgcggaaggacggcgagtgggtcctgctcagcaccttcctgtga

SEQ ID NO: 11938 - RNA, 3534 nt, synthetic construct
  misc_feature 1..3534: note = SARS-CoV-2/Wuhan/WIV05/2019__EPI_ISL_402128 spike protein CDS gc (1-1147)(K986P_V987P) Foldon construct
  source 1..3534: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcgggagcggctacatccccgaggccccgcgcgacgggcaggcctacgtgcggaaggacggcgagtgggtcctgctcagcaccttcctgtga

SEQ ID NO: 11939 - RNA, 3534 nt, synthetic construct
  misc_feature 1..3534: note = SARS-CoV-2/Wuhan/WIV05/2019__EPI_ISL_402128 spike protein CDS gc (1-1147)(K986P_V987P_T887WN_A1020W) Foldon construct
  source 1..3534: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggtggttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgctggagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcgggagcggctacatccccgaggccccgcgcgacgggcaggcctacgtgcggaaggacggcgagtgggtcctgctcagcaccttcctgtga

SEQ ID NO: 11940 - RNA, 3534 nt, synthetic construct
  misc_feature 1..3534: note = SARS-CoV-2/Wuhan/WIV05/2019__EPI_ISL_402128 spike protein CDS gc (1-1147)(K986P_V987P_P1069F) Foldon construct
  source 1..3534: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtcttcgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcgggagcggctacatccccgaggccccgcgcgacgggcaggcctacgtgcggaaggacggcgagtgggtcctgctcagcaccttcctgtga

SEQ ID NO: 11941 - RNA, 3534 nt, synthetic construct
  misc_feature 1..3534: note = SARS-CoV-2/Wuhan/WIV05/2019__EPI_ISL_402128 spike protein CDS gc (1-1147)(K986P_V987P_ H1048Q_H1064N_ H1083N_H1101N) Foldon construct
  source 1..3534: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccagctgatgtccttcccccagagcgccccgcacggcgtggtcttcctcaacgtgacgtacgtccccgcccaggagaagaacttcaccaccgcccccgcgatctgcaacgacgggaaggcccacttcccccgcgagggcgtgttcgtgtccaacgggaccaactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcgggagcggctacatccccgaggccccgcgcgacgggcaggcctacgtgcggaaggacggcgagtgggtcctgctcagcaccttcctgtga

SEQ ID NO: 11942 - RNA, 3534 nt, synthetic construct
  misc_feature 1..3534: note = SARS-CoV-2/Wuhan/WIV05/2019__EPI_ISL_402128 spike protein CDS gc (1-1147)(I712C_T1077C) Foldon construct
  source 1..3534: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagctgcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcacctgcgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcgggagcggctacatccccgaggccccgcgcgacgggcaggcctacgtgcggaaggacggcgagtgggtcctgctcagcaccttcctgtga

SEQ ID NO: 11943 - RNA, 3534 nt, synthetic construct
  misc_feature 1..3534: note = SARS-CoV-2/Wuhan/WIV05/2019__EPI_ISL_402128 spike protein CDS gc (1-1147)(I714C_Y1110C) Foldon construct
  source 1..3534: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgcctgccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctgcgagccgcagatcatcaccaccgacaacaccttcgtgagcggcaactgcgacgtggtcatcggcatcgtgaacaacacggtgtacgaccccctgcagcccgagctggactccggcgggagcggctacatccccgaggccccgcgcgacgggcaggcctacgtgcggaaggacggcgagtgggtcctgctcagcaccttcctgtga

SEQ ID NO: 11944 - RNA, 3534 nt, synthetic construct
  misc_feature 1..3534: note = SARS-CoV-2/Wuhan/WIV05/2019__EPI_ISL_402128 spike protein CDS gc (1-1147)(P715C_P1069C) Foldon construct
  source 1..3534: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatctgcaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtctgcgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcgggagcggctacatccccgaggccccgcgcgacgggcaggcctacgtgcggaaggacggcgagtgggtcctgctcagcaccttcctgtga

SEQ ID NO: 11945 - RNA, 3534 nt, synthetic construct
  misc_feature 1..3534: note = SARS-CoV-2/Wuhan/WIV05/2019__EPI_ISL_402128 spike protein CDS gc (1-1147)(G889C_L1034C) Foldon construct
  source 1..3534: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttctgcgccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtctgcggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcgggagcggctacatccccgaggccccgcgcgacgggcaggcctacgtgcggaaggacggcgagtgggtcctgctcagcaccttcctgtga

SEQ ID NO: 11946 - RNA, 3534 nt, synthetic construct
  misc_feature 1..3534: note = SARS-CoV-2/Wuhan/WIV05/2019__EPI_ISL_402128 spike protein CDS gc (1-1147)(I909C_Y1047C) Foldon construct
  source 1..3534: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggctgcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtgccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcgggagcggctacatccccgaggccccgcgcgacgggcaggcctacgtgcggaaggacggcgagtgggtcctgctcagcaccttcctgtga

SEQ ID NO: 11947 - RNA, 3534 nt, synthetic construct
  misc_feature 1..3534: note = SARS-CoV-2/Wuhan/WIV05/2019__EPI_ISL_402128 spike protein CDS gc (1-1147)(Q965C_S1003C) Foldon construct
  source 1..3534: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagtgcctgtccagcaacttcggcgccatctccagcgtgctgaacgacatcctctcccgcctggacaaggtcgaggccgaggtgcagatcgaccggctgatcaccgggcgcctccagtgcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcgggagcggctacatccccgaggccccgcgcgacgggcaggcctacgtgcggaaggacggcgagtgggtcctgctcagcaccttcctgtga

SEQ ID NO: 11948 - RNA, 3534 nt, synthetic construct
  misc_feature 1..3534: note = SARS-CoV-2/Wuhan/WIV05/2019__EPI_ISL_402128 spike protein CDS gc (1-1147)(F970C_G999C) Foldon construct
  source 1..3534: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaactgcggcgccatctccagcgtgctgaacgacatcctctcccgcctggacaaggtcgaggccgaggtgcagatcgaccggctgatcacctgtcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcgggagcggctacatccccgaggccccgcgcgacgggcaggcctacgtgcggaaggacggcgagtgggtcctgctcagcaccttcctgtga

SEQ ID NO: 11949 - RNA, 3534 nt, synthetic construct
  misc_feature 1..3534: note = SARS-CoV-2/Wuhan/WIV05/2019__EPI_ISL_402128 spike protein CDS gc (1-1147)(A972C_R995C) Foldon construct
  source 1..3534: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggctgcatctccagcgtgctgaacgacatcctctcccgcctggacaaggtcgaggccgaggtgcagatcgactgcctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcgggagcggctacatccccgaggccccgcgcgacgggcaggcctacgtgcggaaggacggcgagtgggtcctgctcagcaccttcctgtga

SEQ ID NO: 11950 - RNA, 3534 nt, synthetic construct
  misc_feature 1..3534: note = SARS-CoV-2/Wuhan/WIV05/2019__EPI_ISL_402128 spike protein CDS gc (1-1147)(A890C_V1040C) Foldon construct
  source 1..3534: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcgggtgcggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcggtgcgacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcgggagcggctacatccccgaggccccgcgcgacgggcaggcctacgtgcggaaggacggcgagtgggtcctgctcagcaccttcctgtga

SEQ ID NO: 11951 - RNA, 3534 nt, synthetic construct
  misc_feature 1..3534: note = SARS-CoV-2/Wuhan/WIV05/2019__EPI_ISL_402128 spike protein CDS gc (1-1147)(T874C_S1055C) Foldon construct
  source 1..3534: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtactgcagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagtgcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcgggagcggctacatccccgaggccccgcgcgacgggcaggcctacgtgcggaaggacggcgagtgggtcctgctcagcaccttcctgtga

SEQ ID NO: 11952 - RNA, 3906 nt, synthetic construct
  misc_feature 1..3906: note = SARS-CoV-2/Wuhan/WIV05/2019__EPI_ISL_402128 spike protein CDS gc (1-1147) WhcAg construct
  source 1..3906: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcgggggcgggagcgacatcgacccctacaaggagttcggcagctcctaccagctgctcaacttcctgcccctggacttcttccccgacctcaacgccctggtggacaccgccaccgcgctgtacgaggaggagctcacggggcgcgagcactgcagcccccaccacaccgccatccggcaggccctggtctgctgggacgagctgaccaagctcatcgcctggatgtccagcaacatcacctccgagcaggtccgcacgatcatcgtgaaccacgtcaacgacacctggggcctgaaggtgcggcagagcctgtggttccacctctcctgcctgaccttcgggcagcacaccgtgcaggagttcctggtcagcttcggcgtgtggatccgcacgcccgccccgtaccggccgcccaacgcgccgatcctctccaccctgccggagcacaccgtgatctgctga

SEQ ID NO: 11953 - RNA, 3906 nt, synthetic construct
  misc_feature 1..3906: note = SARS-CoV-2/Wuhan/WIV05/2019__EPI_ISL_402128 spike protein CDS gc (1-1147)(K986P_V987P) WhcAg construct
  source 1..3906: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcgggggcgggagcgacatcgacccctacaaggagttcggcagctcctaccagctgctcaacttcctgcccctggacttcttccccgacctcaacgccctggtggacaccgccaccgcgctgtacgaggaggagctcacggggcgcgagcactgcagcccccaccacaccgccatccggcaggccctggtctgctgggacgagctgaccaagctcatcgcctggatgtccagcaacatcacctccgagcaggtccgcacgatcatcgtgaaccacgtcaacgacacctggggcctgaaggtgcggcagagcctgtggttccacctctcctgcctgaccttcgggcagcacaccgtgcaggagttcctggtcagcttcggcgtgtggatccgcacgcccgccccgtaccggccgcccaacgcgccgatcctctccaccctgccggagcacaccgtgatctgctga

SEQ ID NO: 11954 - RNA, 3906 nt, synthetic construct
  misc_feature 1..3906: note = SARS-CoV-2/Wuhan/WIV05/2019__EPI_ISL_402128 spike protein CDS gc (1-1147)(K986P_V987P_T887WN_A1020W) WhcAg construct
  source 1..3906: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggtggttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgctggagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcgggggcgggagcgacatcgacccctacaaggagttcggcagctcctaccagctgctcaacttcctgcccctggacttcttccccgacctcaacgccctggtggacaccgccaccgcgctgtacgaggaggagctcacggggcgcgagcactgcagcccccaccacaccgccatccggcaggccctggtctgctgggacgagctgaccaagctcatcgcctggatgtccagcaacatcacctccgagcaggtccgcacgatcatcgtgaaccacgtcaacgacacctggggcctgaaggtgcggcagagcctgtggttccacctctcctgcctgaccttcgggcagcacaccgtgcaggagttcctggtcagcttcggcgtgtggatccgcacgcccgccccgtaccggccgcccaacgcgccgatcctctccaccctgccggagcacaccgtgatctgctga

SEQ ID NO: 11955 - RNA, 3906 nt, synthetic construct
  misc_feature 1..3906: note = SARS-CoV-2/Wuhan/WIV05/2019__EPI_ISL_402128 spike protein CDS gc (1-1147)(K986P_V987P_P1069F) WhcAg construct
  source 1..3906: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtcttcgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcgggggcgggagcgacatcgacccctacaaggagttcggcagctcctaccagctgctcaacttcctgcccctggacttcttccccgacctcaacgccctggtggacaccgccaccgcgctgtacgaggaggagctcacggggcgcgagcactgcagcccccaccacaccgccatccggcaggccctggtctgctgggacgagctgaccaagctcatcgcctggatgtccagcaacatcacctccgagcaggtccgcacgatcatcgtgaaccacgtcaacgacacctggggcctgaaggtgcggcagagcctgtggttccacctctcctgcctgaccttcgggcagcacaccgtgcaggagttcctggtcagcttcggcgtgtggatccgcacgcccgccccgtaccggccgcccaacgcgccgatcctctccaccctgccggagcacaccgtgatctgctga

SEQ ID NO: 11956 - RNA, 3906 nt, synthetic construct
  misc_feature 1..3906: note = SARS-CoV-2/Wuhan/WIV05/2019__EPI_ISL_402128 spike protein CDS gc (1-1147)(K986P_V987P_ H1048Q_H1064N_ H1083N_H1101N) WhcAg construct
  source 1..3906: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccagctgatgtccttcccccagagcgccccgcacggcgtggtcttcctcaacgtgacgtacgtccccgcccaggagaagaacttcaccaccgcccccgcgatctgcaacgacgggaaggcccacttcccccgcgagggcgtgttcgtgtccaacgggaccaactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcgggggcgggagcgacatcgacccctacaaggagttcggcagctcctaccagctgctcaacttcctgcccctggacttcttccccgacctcaacgccctggtggacaccgccaccgcgctgtacgaggaggagctcacggggcgcgagcactgcagcccccaccacaccgccatccggcaggccctggtctgctgggacgagctgaccaagctcatcgcctggatgtccagcaacatcacctccgagcaggtccgcacgatcatcgtgaaccacgtcaacgacacctggggcctgaaggtgcggcagagcctgtggttccacctctcctgcctgaccttcgggcagcacaccgtgcaggagttcctggtcagcttcggcgtgtggatccgcacgcccgccccgtaccggccgcccaacgcgccgatcctctccaccctgccggagcacaccgtgatctgctga

SEQ ID NO: 11957 - RNA, 3906 nt, synthetic construct
  misc_feature 1..3906: note = SARS-CoV-2/Wuhan/WIV05/2019__EPI_ISL_402128 spike protein CDS gc (1-1147)(I712C_T1077C) WhcAg construct
  source 1..3906: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagctgcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcacctgcgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcgggggcgggagcgacatcgacccctacaaggagttcggcagctcctaccagctgctcaacttcctgcccctggacttcttccccgacctcaacgccctggtggacaccgccaccgcgctgtacgaggaggagctcacggggcgcgagcactgcagcccccaccacaccgccatccggcaggccctggtctgctgggacgagctgaccaagctcatcgcctggatgtccagcaacatcacctccgagcaggtccgcacgatcatcgtgaaccacgtcaacgacacctggggcctgaaggtgcggcagagcctgtggttccacctctcctgcctgaccttcgggcagcacaccgtgcaggagttcctggtcagcttcggcgtgtggatccgcacgcccgccccgtaccggccgcccaacgcgccgatcctctccaccctgccggagcacaccgtgatctgctga

SEQ ID NO: 11958 - RNA, 3906 nt, synthetic construct
  misc_feature 1..3906: note = SARS-CoV-2/Wuhan/WIV05/2019__EPI_ISL_402128 spike protein CDS gc (1-1147)(I714C_Y1110C) WhcAg construct
  source 1..3906: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgcctgccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctgcgagccgcagatcatcaccaccgacaacaccttcgtgagcggcaactgcgacgtggtcatcggcatcgtgaacaacacggtgtacgaccccctgcagcccgagctggactccggcgggggcgggagcgacatcgacccctacaaggagttcggcagctcctaccagctgctcaacttcctgcccctggacttcttccccgacctcaacgccctggtggacaccgccaccgcgctgtacgaggaggagctcacggggcgcgagcactgcagcccccaccacaccgccatccggcaggccctggtctgctgggacgagctgaccaagctcatcgcctggatgtccagcaacatcacctccgagcaggtccgcacgatcatcgtgaaccacgtcaacgacacctggggcctgaaggtgcggcagagcctgtggttccacctctcctgcctgaccttcgggcagcacaccgtgcaggagttcctggtcagcttcggcgtgtggatccgcacgcccgccccgtaccggccgcccaacgcgccgatcctctccaccctgccggagcacaccgtgatctgctga

SEQ ID NO: 11959 - RNA, 3906 nt, synthetic construct
  misc_feature 1..3906: note = SARS-CoV-2/Wuhan/WIV05/2019__EPI_ISL_402128 spike protein CDS gc (1-1147)(P715C_P1069C) WhcAg construct
  source 1..3906: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatctgcaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtctgcgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcgggggcgggagcgacatcgacccctacaaggagttcggcagctcctaccagctgctcaacttcctgcccctggacttcttccccgacctcaacgccctggtggacaccgccaccgcgctgtacgaggaggagctcacggggcgcgagcactgcagcccccaccacaccgccatccggcaggccctggtctgctgggacgagctgaccaagctcatcgcctggatgtccagcaacatcacctccgagcaggtccgcacgatcatcgtgaaccacgtcaacgacacctggggcctgaaggtgcggcagagcctgtggttccacctctcctgcctgaccttcgggcagcacaccgtgcaggagttcctggtcagcttcggcgtgtggatccgcacgcccgccccgtaccggccgcccaacgcgccgatcctctccaccctgccggagcacaccgtgatctgctga

SEQ ID NO: 11960 - RNA, 3906 nt, synthetic construct
  misc_feature 1..3906: note = SARS-CoV-2/Wuhan/WIV05/2019__EPI_ISL_402128 spike protein CDS gc (1-1147)(G889C_L1034C) WhcAg construct
  source 1..3906: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttctgcgccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtctgcggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcgggggcgggagcgacatcgacccctacaaggagttcggcagctcctaccagctgctcaacttcctgcccctggacttcttccccgacctcaacgccctggtggacaccgccaccgcgctgtacgaggaggagctcacggggcgcgagcactgcagcccccaccacaccgccatccggcaggccctggtctgctgggacgagctgaccaagctcatcgcctggatgtccagcaacatcacctccgagcaggtccgcacgatcatcgtgaaccacgtcaacgacacctggggcctgaaggtgcggcagagcctgtggttccacctctcctgcctgaccttcgggcagcacaccgtgcaggagttcctggtcagcttcggcgtgtggatccgcacgcccgccccgtaccggccgcccaacgcgccgatcctctccaccctgccggagcacaccgtgatctgctga

SEQ ID NO: 11961 - RNA, 3906 nt, synthetic construct
  misc_feature 1..3906: note = SARS-CoV-2/Wuhan/WIV05/2019__EPI_ISL_402128 spike protein CDS gc (1-1147)(I909C_Y1047C) WhcAg construct
  source 1..3906: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggctgcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtgccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcgggggcgggagcgacatcgacccctacaaggagttcggcagctcctaccagctgctcaacttcctgcccctggacttcttccccgacctcaacgccctggtggacaccgccaccgcgctgtacgaggaggagctcacggggcgcgagcactgcagcccccaccacaccgccatccggcaggccctggtctgctgggacgagctgaccaagctcatcgcctggatgtccagcaacatcacctccgagcaggtccgcacgatcatcgtgaaccacgtcaacgacacctggggcctgaaggtgcggcagagcctgtggttccacctctcctgcctgaccttcgggcagcacaccgtgcaggagttcctggtcagcttcggcgtgtggatccgcacgcccgccccgtaccggccgcccaacgcgccgatcctctccaccctgccggagcacaccgtgatctgctga

SEQ ID NO: 11962 - RNA, 3906 nt, synthetic construct
  misc_feature 1..3906: note = SARS-CoV-2/Wuhan/WIV05/2019__EPI_ISL_402128 spike protein CDS gc (1-1147)(Q965C_S1003C) WhcAg construct
  source 1..3906: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagtgcctgtccagcaacttcggcgccatctccagcgtgctgaacgacatcctctcccgcctggacaaggtcgaggccgaggtgcagatcgaccggctgatcaccgggcgcctccagtgcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcgggggcgggagcgacatcgacccctacaaggagttcggcagctcctaccagctgctcaacttcctgcccctggacttcttccccgacctcaacgccctggtggacaccgccaccgcgctgtacgaggaggagctcacggggcgcgagcactgcagcccccaccacaccgccatccggcaggccctggtctgctgggacgagctgaccaagctcatcgcctggatgtccagcaacatcacctccgagcaggtccgcacgatcatcgtgaaccacgtcaacgacacctggggcctgaaggtgcggcagagcctgtggttccacctctcctgcctgaccttcgggcagcacaccgtgcaggagttcctggtcagcttcggcgtgtggatccgcacgcccgccccgtaccggccgcccaacgcgccgatcctctccaccctgccggagcacaccgtgatctgctga

SEQ ID NO: 11963 - RNA, 3906 nt, synthetic construct
  misc_feature 1..3906: note = SARS-CoV-2/Wuhan/WIV05/2019__EPI_ISL_402128 spike protein CDS gc (1-1147)(F970C_G999C) WhcAg construct
  source 1..3906: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaactgcggcgccatctccagcgtgctgaacgacatcctctcccgcctggacaaggtcgaggccgaggtgcagatcgaccggctgatcacctgtcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcgggggcgggagcgacatcgacccctacaaggagttcggcagctcctaccagctgctcaacttcctgcccctggacttcttccccgacctcaacgccctggtggacaccgccaccgcgctgtacgaggaggagctcacggggcgcgagcactgcagcccccaccacaccgccatccggcaggccctggtctgctgggacgagctgaccaagctcatcgcctggatgtccagcaacatcacctccgagcaggtccgcacgatcatcgtgaaccacgtcaacgacacctggggcctgaaggtgcggcagagcctgtggttccacctctcctgcctgaccttcgggcagcacaccgtgcaggagttcctggtcagcttcggcgtgtggatccgcacgcccgccccgtaccggccgcccaacgcgccgatcctctccaccctgccggagcacaccgtgatctgctga

SEQ ID NO: 11964 - RNA, 3906 nt, synthetic construct
  misc_feature 1..3906: note = SARS-CoV-2/Wuhan/WIV05/2019__EPI_ISL_402128 spike protein CDS gc (1-1147)(A972C_R995C) WhcAg construct
  source 1..3906: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggctgcatctccagcgtgctgaacgacatcctctcccgcctggacaaggtcgaggccgaggtgcagatcgactgcctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcgggggcgggagcgacatcgacccctacaaggagttcggcagctcctaccagctgctcaacttcctgcccctggacttcttccccgacctcaacgccctggtggacaccgccaccgcgctgtacgaggaggagctcacggggcgcgagcactgcagcccccaccacaccgccatccggcaggccctggtctgctgggacgagctgaccaagctcatcgcctggatgtccagcaacatcacctccgagcaggtccgcacgatcatcgtgaaccacgtcaacgacacctggggcctgaaggtgcggcagagcctgtggttccacctctcctgcctgaccttcgggcagcacaccgtgcaggagttcctggtcagcttcggcgtgtggatccgcacgcccgccccgtaccggccgcccaacgcgccgatcctctccaccctgccggagcacaccgtgatctgctga

SEQ ID NO: 11965 - RNA, 3906 nt, synthetic construct
  misc_feature 1..3906: note = SARS-CoV-2/Wuhan/WIV05/2019__EPI_ISL_402128 spike protein CDS gc (1-1147)(A890C_V1040C) WhcAg construct
  source 1..3906: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcgggtgcggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcggtgcgacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcgggggcgggagcgacatcgacccctacaaggagttcggcagctcctaccagctgctcaacttcctgcccctggacttcttccccgacctcaacgccctggtggacaccgccaccgcgctgtacgaggaggagctcacggggcgcgagcactgcagcccccaccacaccgccatccggcaggccctggtctgctgggacgagctgaccaagctcatcgcctggatgtccagcaacatcacctccgagcaggtccgcacgatcatcgtgaaccacgtcaacgacacctggggcctgaaggtgcggcagagcctgtggttccacctctcctgcctgaccttcgggcagcacaccgtgcaggagttcctggtcagcttcggcgtgtggatccgcacgcccgccccgtaccggccgcccaacgcgccgatcctctccaccctgccggagcacaccgtgatctgctga

SEQ ID NO: 11966 - RNA, 3906 nt, synthetic construct
  misc_feature 1..3906: note = SARS-CoV-2/Wuhan/WIV05/2019__EPI_ISL_402128 spike protein CDS gc (1-1147)(T874C_S1055C) WhcAg construct
  source 1..3906: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtactgcagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagtgcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccggcgggggcgggagcgacatcgacccctacaaggagttcggcagctcctaccagctgctcaacttcctgcccctggacttcttccccgacctcaacgccctggtggacaccgccaccgcgctgtacgaggaggagctcacggggcgcgagcactgcagcccccaccacaccgccatccggcaggccctggtctgctgggacgagctgaccaagctcatcgcctggatgtccagcaacatcacctccgagcaggtccgcacgatcatcgtgaaccacgtcaacgacacctggggcctgaaggtgcggcagagcctgtggttccacctctcctgcctgaccttcgggcagcacaccgtgcaggagttcctggtcagcttcggcgtgtggatccgcacgcccgccccgtaccggccgcccaacgcgccgatcctctccaccctgccggagcacaccgtgatctgctga

SEQ ID NO: 11967 - RNA, 3822 nt, synthetic construct
  misc_feature 1..3822: note = SARS-CoV-2/Wuhan/WIV05/2019__EPI_ISL_402128 spike protein CDS human (1-1273)
  source 1..3822: mol_type = other RNA
atgttcgtgtttctggtcctccttcccctggttagctcccagtgcgtgaacttgaccacaagaactcaattacctccagcctacactaattctttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgagttccgtgtgtacagctccgcgaataactgtacttttgaatatgtgtcacaacctttcctgatggacctggaaggcaagcagggtaattttaaaaacctcagagagttcgtctttaagaacattgatgggtacttcaaaatctacagtaagcacaccccaataaatttagttagggacctgccccagggatttagcgctcttgagcctttggtggatctgccaatcggcattaacatcacacggttccagactctactcgccctgcatcgctcttatcttaccccgggcgactcctcaagcgggtggacagcaggagccgctgcatactatgtaggttacctgcaacccagaacctttttgctcaaatataatgaaaacggcacgattactgatgccgtggactgcgctctggatcctttaagtgagacaaagtgtaccctgaagtctttcactgtcgaaaaagggatctaccagacatccaattttagggtgcagccaaccgagagcatagttcggttccccaacattacgaatctctgcccttttggagaggtgttcaacgccacccgcttcgcgtcggtctatgcatggaatcgaaagagaatctctaactgtgtggccgactactccgtactttacaattcagctagttttagcacattcaaatgctatggcgtttccccaactaagctgaacgacttgtgttttaccaatgtgtacgccgattctttcgtcattaggggtgacgaagtgcggcagatcgcacccgggcaaacaggaaaaatcgctgattataactacaagctaccggacgattttactggctgcgtcattgcctggaatagcaacaacctggactcaaaagtgggcgggaattataactacctctatcgtctgttccgcaagagtaatcttaagccttttgagagagatatatccaccgaaatctaccaggcgggaagcacaccctgtaacggtgttgagggcttcaattgctactttccactgcagtcttatgggttccaacctaccaacggagtgggctaccagccctatagggtagtcgtgttgtcatttgaactcctgcacgccccagcaactgtttgcggtcccaaaaagagtacgaatttagtgaaaaacaagtgtgtcaatttcaactttaatgggctgacaggcaccggagtgctaactgagagcaacaaaaagttcctccctttccagcagtttggccgggacattgctgataccacagacgccgtacgagatccacaaaccctggagatccttgacataactccgtgctccttcgggggagtgtctgttattacacccggtacgaatacctcgaaccaggtcgctgtgttgtaccaggacgtgaattgtactgaagtccctgttgccatccacgcagatcagctgacaccaacctggcgcgtgtatagcacaggctccaacgtgtttcaaactagagccgggtgcctcatcggagctgagcatgtaaacaattcatacgaatgtgacattcccatcggcgcgggtatttgcgcaagttatcagacccagacgaactctcctaggcgggcccgcagcgtcgcttcccagtcaataatcgcctacaccatgagcctgggggcagaaaattctgtggcctactccaacaatagtattgctatcccaacaaacttcactatcagcgttaccacagaaattcttcccgtgtctatgactaagacctccgtcgattgtacgatgtatatatgcggcgactcaacagagtgtagtaatctgttgctccaatacggcagcttttgcacccagctgaacagagccttaactggaatcgcagtggagcaggataaaaatacacaggaagttttcgcgcaagtgaagcagatttataaaaccccgcctatcaaggactttgggggattcaacttttcgcagattctgccagatccctccaaaccttctaagaggagcttcatcgaggacctactctttaataaggtaactctggctgatgccggtttcataaaacaatacggcgactgtcttggggatatcgcagcccgtgacttgatttgcgctcagaagttcaacggactgaccgtcctgcccccactcttaacagatgaaatgatcgcccagtatacgtcagcactgcttgctggcaccattacgagtggttggacatttggggccggcgcggccttgcagatccctttcgctatgcaaatggcataccggtttaatggaataggcgtgacccagaacgtgctctatgagaatcagaaactgattgccaaccagttcaactccgctatcgggaagattcaagactctctaagctccacagcctcagcactgggaaaactccaggacgtcgttaatcagaacgcgcaggccctgaatactcttgtgaagcaattgagcagtaactttggcgctatctcttccgtactgaatgatatattaagccgactcgacaaggtggaagccgaggtccagatcgatagactgattaccggtaggcttcagtcgctgcaaacgtacgtgacacagcagttgatccgcgcagctgagattcgggcctcagcaaacctcgccgctaccaaaatgtctgaatgcgttctggggcagagtaagagagtggacttctgtggaaaaggctaccacctaatgtcctttccccaaagcgcgccacatggtgtcgtgttcctgcacgttacttatgtgccggcccaggagaagaattttaccacagctcctgcaatctgccacgatggcaaagcccatttccccagggaaggggtctttgtatctaacggaactcactggttcgtgacccagcgcaatttttacgagccacagataattacaacggacaacaccttcgttagcggcaattgtgatgtggtcatcgggatcgtgaacaatactgtatatgaccccctccaacctgagctggattccttcaaggaggaacttgacaaatactttaagaaccatacatcaccagatgtggacttgggagatattagtggcatcaatgccagcgtcgttaacattcagaaggaaatagaccgactgaatgaggtggctaaaaacttaaacgaatctctcatcgacctgcaggagcttggtaagtatgagcagtacattaaatggccctggtatatctggctggggttcattgcaggactaatcgccatagtgatggtcaccatcatgctctgctgtatgacttcctgctgttcatgcctgaagggctgttgcagttgtggtagctgctgcaaatttgatgaagacgattccgagcctgtgttgaagggcgttaagctgcactacacatga

SEQ ID NO: 11968 - RNA, 3810 nt, synthetic construct
  misc_feature 1..3810: note = SARS-CoV-2/bat/Yunnan/RaTG13/2013__EPI_ISL_402131 spike protein CDS human (1-1269)
  source 1..3810: mol_type = other RNA
atgttcgtgtttctggtcctccttcccctggttagctcccagtgcgtgaacttgaccacaagaactcaattacctccagcctacaccaattcttcaacgaggggcgtatattacccggacaaggtgttccggagtagcgtcctgcacctaacacaggatctctttctgcccttcttttccaacgtgacttggttccatgctatccacgtttctgggaccaatggaattaaacgctttgacaaccctgtgcttccattcaatgatggtgtctattttgcatcgacagagaagtcaaacataatccgaggctggattttcgggaccactctggacagcaaaacacagagtttgctcatcgtgaataacgccaccaatgtagttattaaggtgtgtgaatttcagttctgcaacgatccctttctgggagtctactatcataaaaataacaagtcctggatggagtctgagttccgtgtgtacagctccgcgaataactgtacgttcgaatatgtgtcacaaccttttctgatggacctcgaaggcaagcagggtaatttcaaaaacttaagagagtttgtcttcaagaacatcgatgggtactttaaaatatacagtaagcacactccaatcaatctggttagggaccttccccctggattcagcgctttggagccactggtggatctaccgattggcatcaacattacccggtttcagacactcctggcccttcatcgctcttatctgactcccggcgactcctcaagcgggtggaccgcaggagccgctgcatactatgtaggttacttgcagcctagaacattcctcctgaaatataatgaaaacggcaccatcacggatgccgtggactgcgctttagatccactgagtgagactaagtgtacactcaagtcttttaccgtcgaaaaagggatataccaaacttccaatttcagggtgcagcccacagacagcattgttcggtttcctaacatcaccaatctttgcccattcggagaggtgtttaacgccacgaccttcgcgtcggtctatgcatggaatcgcaagcgaatttctaactgtgtggccgactactccgtactgtacaattcaacaagtttcagcacttttaaatgctatggcgtttcccccaccaagttgaacgatctatgtttcacaaatgtgtacgctgactcttttgtcatcactggtgatgaggtgagacagatcgccccggggcagaccggaaaaattgcagactataactacaagctgcctgatgacttcacaggctgcgtcatagcttggaatagcaaacacatcgatgccaaggaaggcgggaactttaactatctctacaggctgttccggaaggcgaatcttaaaccctttgagcgtgacatttcaaccgaaatctatcaagccggaagtaagccatgtaacggtcagactggcctgaattgctactaccctttgtatcgctacgggttctatcccacggatggagtgggccaccagccatacagagttgtggtactctcctttgagctgttaaacgcacccgctacagtctgcggtcctaaaaagagcaccaatctggtgaaaaacaagtgtgttaatttcaactttaatgggctaactggcaccggagtgctcacagaatctaacaagaaattcctgccatttcaacagttcggcagggacatagccgataccactgacgctgtccgggacccgcagacacttgagattttggatatcacgccctgctcattcgggggagtgagtgtaatcacccctggtactaatgccagcaaccaggtggcagttctgtatcaagacgtcaattgtacagaggtgccagtggccattcatgctgatcagctcacccccacatggcgagtctactccactggctctaacgtttttcagacccgcgcggggtgcctgatcggagcagaacacgtgaataactcgtatgagtgtgacattcctataggcgccggtatctgcgctagctaccagacgcaaaccaactccagatcagtggccagtcagtctattatcgcatacacaatgagccttggggccgaaaattccgtagcttattcaaacaatagcatcgccattccaactaacttcaccatatctgtcacaactgagatcctgcccgtgtccatgaccaagacgagtgttgattgtacaatgtacatttgcggcgacagcaccgaatgttctaatttgctcctgcagtatggatccttttgcactcagttaaacagggcactgacaggcatcgcggtggagcaagataaaaatacccaggaggtcttcgctcaggtgaagcagatttacaaaactccgcctatcaaggactttgggggattcaacttttcacaaatactaccagatcccagtaagcctagcaaacggtcgttcatcgaagacctcctgtttaataaggttacccttgccgatgcaggtttcattaaacagtatggcgactgtttgggggatatcgccgctcgcgacctgatttgcgcccagaagtttaacggactcacagtgctgcccccattactgacggacgagatgatcgcacaatacacctccgctcttttggccggcactataacatctggttggaccttcggggcgggcgccgctctccagattcctttcgcaatgcagatggcctatagatttaatggaatcggcgtaacacagaacgtcctgtacgaaaatcaaaaactaattgctaaccagttcaatagcgccatcgggaagatacaggattcactgagttccactgcatctgcgctcggaaagctgcaggacgtggtgaaccaaaacgcccaggctcttaataccttggtcaaacagctgagctccaactttggcgccatctcaagcgttttaaatgatattctcagtaggctggacaaggtggaggcagaagtacagatcgatcgtcttattacgggtcggctgcaatctttgcagacatacgtgacccagcaactcatccgagctgccgagataagagcatccgccaacctggctgcgactaaaatgagcgagtgcgtcctagggcagtcgaagagggtggacttctgtggaaaaggctatcatctgatgtcatttccccagtctgccccacacggtgttgtgttcctccacgtcacctacgtgccggcacaggaaaagaattttacaactgctcctgccatttgccatgatggcaaagcccacttcccccgcgagggggtttttgtgagtaacggaacccattggttcgtcacacaacggaatttttatgaaccacagatcatcacgaccgacaacactttcgtatccggcagctgtgatgtggttattgggatcgtgaataacacagtctacgaccccctgcagcctgagcttgattcttttaaggaggaattggacaagtatttcaaaaatcacaccagcccagatgtggacctgggagacatttccggcataaacgcttcagtagtgaatatccagaaggagattgatagattaaacgaagtcgccaaaaatctcaacgagagtctgatcgaccttcaagaactgggtaagtacgagcagtatattaaatggccctggtacatctggctagggttcatagcaggactcatcgcgattatcatggttactattatgctgtgctgtatgacaagctgctgttcttgcttgaagggctgttgctcctgtggttcatgctgcaagtttgatgaggacgatagtgaacctgtgctgaaaggcgtgaagttacattacacctga

SEQ ID NO: 11969 - RNA, 3822 nt, synthetic construct
  misc_feature 1..3822: note = SARS-CoV-2/Wuhan/HBCDC-HB-01/2019__EPI_ISL_402132 spike protein CDS human (1-1273)
  source 1..3822: mol_type = other RNA
atgttcgtgtttctggtcctccttcccctggttagctcccagtgcgtgaacttgaccacaagaactcaattacctccagcctacactaattctatcaccaggggcgtatattacccggacaaggtgttccggtcaagtgtcctgcacagcacacaggatctatttctccccttcttttccaacgtgacttggttccatgctattcacgtttctgggaccaatggaacaaaacgctttgacaaccctgtgctgccattcaatgatggtgtctattttgcatcgaccgagaagtcaaacataatccgaggctggattttcgggactacacttgacagcaaaacccagagtctgttgatcgtgaataacgccacgaatgtagttattaaggtgtgtgaatttcagttctgcaacgatccctttctcggagtctactatcataaaaataacaagtcctggatggagtctgagttccgtgtgtacagctccgcgaataactgtactttcgagtatgtgtcacaaccttttctgatggacctggaaggcaagcagggtaatttcaaaaacctcagagagtttgtcttcaagaacatcgatgggtactttaaaatatacagtaagcacaccccaatcaatttagttagggacctgccccagggattcagcgctcttgagcctttggtggatctgccaattggcatcaacattacacggtttcagactctactcgccctgcatcgctcttatcttaccccgggcgactcctcaagcgggtggacagcaggagccgctgcatactatgtaggttacctgcaacccagaaccttcttgctcaaatataatgaaaacggcacgatcactgatgccgtggactgcgctctggatcctttaagtgagacaaagtgtaccctgaagtcttttactgtcgaaaaagggatataccagacatccaatttcagggtgcagccaaccgagagcattgttcggtttcccaacatcacgaatctctgccctttcggagaggtgtttaacgccacccgcttcgcgtcggtctatgcatggaatcgaaagagaatttctaactgtgtggccgactactccgtactttacaattcagctagtttcagcacatttaaatgctatggcgtttccccaactaagctgaacgacttgtgtttcaccaatgtgtacgccgattcttttgtcatcaggggtgacgaagtgcggcagatcgcacccgggcaaacaggaaaaattgctgattataactacaagctaccggacgatttcactggctgcgtcatagcctggaatagcaacaacctggactcaaaagtgggcgggaattataactacctctatcgtctgtttcgcaagagtaatcttaagcctttcgagagagatatctccaccgaaatttaccaggcgggaagcacaccctgtaacggtgttgagggctttaattgctacttcccactgcagtcttatgggtttcaacctaccaacggagtgggctaccagccctatagggtagtcgtgttgtcattcgaactcctgcacgccccagcaactgtttgcggtcccaaaaagagtacgaatttagtgaaaaacaagtgtgtcaattttaacttcaatgggctgacaggcaccggagtgctaactgagagcaacaaaaagtttctccctttccagcagttcggccgggacatcgctgataccacagacgccgtacgagatccacaaaccctggagatacttgacattactccgtgctcctttgggggagtgtctgttatcacacccggtacgaatacctcgaaccaggtcgctgtgttgtaccaggacgtgaattgtactgaagtccctgttgccatccacgcagatcagctgacaccaacctggcgcgtgtatagcacaggctccaacgtgttccaaactagagccgggtgcctcattggagctgagcatgtaaacaattcatacgaatgtgacatccccattggcgcgggtatatgcgcaagttatcagacccagacgaactctcctaggcgggcccgcagcgtcgcttcccagtcaatcattgcctacaccatgagcctgggggcagaaaattctgtggcctactccaacaatagtatcgctatcccaacaaactttactattagcgttaccacagaaatacttcccgtgtctatgactaagacctccgtcgattgtacgatgtatatctgcggcgactcaacagagtgtagtaatctgttgctccaatacggcagcttctgcacccagctgaacagagccttaactggaattgcagtggagcaggataaaaatacacaggaagtttttgcgcaagtgaagcagatctataaaaccccgcctattaaggacttcgggggatttaacttctcgcagatcctgccagatccctccaaaccttctaagaggagctttatagaggacctactcttcaataaggtaactctggctgatgccggttttatcaaacaatacggcgactgtcttggggatattgcagcccgtgacttgatctgcgctcagaagttcaacggactgaccgtcctgcccccactcttaacagatgaaatgattgcccagtatacgtcagcactgcttgctggcaccatcacgagtggttggacattcggggccggcgcggccttgcagataccttttgctatgcaaatggcataccggttcaatggaattggcgtgacccagaacgtgctctatgagaatcagaaactgatcgccaaccagtttaactccgctattgggaagatccaagactctctaagctccacagcctcagcactgggaaaactccaggacgtcgttaatcagaacgcgcaggccctgaatactcttgtgaagcaattgagcagtaacttcggcgctatatcttccgtactgaatgatatcttaagccgactcgacaaggtggaagccgaggtccagattgatagactgatcaccggtaggcttcagtcgctgcaaacgtacgtgacacagcagttgattcgcgcagctgagatccgggcctcagcaaacctcgccgctaccaaaatgtctgaatgcgttctggggcagagtaagagagtggacttttgtggaaaaggctaccacctaatgtccttcccccaaagcgcgccacatggtgtcgtgtttctgcacgttacttatgtgccggcccaggagaagaatttcaccacagctcctgcaatatgccacgatggcaaagcccattttcccagggaaggggtcttcgtatctaacggaactcactggtttgtgacccagcgcaatttctacgagccacagattatcacaacggacaacacctttgttagcggcaattgtgatgtggtcatcgggattgtgaacaatactgtatatgaccccctccaacctgagctggattccttcaaggaggaacttgacaaatacttcaagaaccatacatcaccagatgtggacttgggagatatcagtggcattaatgccagcgtcgttaacatacagaaggaaatcgaccgactgaatgaggtggctaaaaacttaaacgaatctctcattgacctgcaggagcttggtaagtatgagcagtacatcaaatggccctggtatatttggctggggtttatcgcaggactaatagccatcgtgatggtcaccattatgctctgctgtatgacttcctgctgttcatgcctgaagggctgttgcagttgtggtagctgctgcaaattcgatgaagacgattccgagcctgtgttgaagggcgttaagctgcactacacatga

SEQ ID NO: 11970 - RNA, 3822 nt, synthetic construct
  misc_feature 1..3822: note = SARS-CoV-2/Guangdong/20SF028/2020__EPI_ISL_403936 spike protein CDS human (1-1273)
  source 1..3822: mol_type = other RNA
atgttcgtgtttctggtcctccttcccctggttagctcccagtgcgtgaacttgaccacaagaactcaattacctccagcctacactaattctttcaccaggggcgtatattacccggacaaggtgtttcggtcaagtgtcctgtatagcacacaggatctattcctcccctttttctccaacgtgacttggtttcacgctatccatgtttctgggaccaatggaacaaaacgcttcgacaaccctgtgctgccatttaatgatggtgtctacttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctattaccacaaaaataacaagtcctggatggagtctgagttccgtgtgtatagctccgcgaataactgtacttttgaatacgtgtcacaacctttcctgatggacctggaaggcaagcagggtaattttaaaaacctcagagagttcgtctttaagaacattgatgggtacttcaaaatctatagtaagcataccccaataaatttagttagggacctgccccagggatttagcgctcttgagcctttggtggatctgccaatcggcattaacatcacacggttccagactctactcgccctgcaccgctcttaccttaccccgggcgactcctcaagcgggtggacagcaggagccgctgcatattacgtaggttatctgcaacccagaacctttttgctcaaatacaatgaaaacggcacgattactgatgccgtggactgcgctctggatcctttaagtgagacaaagtgtaccctgaagtctttcactgtcgaaaaagggatctatcagacatccaattttagggtgcagccaaccgagagcatagttcggttccccaacattacgaatctctgcccttttggagaggtgttcaacgccacccgcttcgcgtcggtctacgcatggaatcgaaagagaatctctaactgtgtggccgactactccgtactttataattcagctagttttagcacattcaaatgctacggcgtttccccaactaagctgaacgacttgtgttttaccaatgtgtatgccgattctttcgtcattaggggtgacgaagtgcggcagatcgcacccgggcaaacaggaaaaatcgctgattacaactataagctaccggacgattttactggctgcgtcattgcctggaatagcaacaacctggactcaaaagtgggcgggaattacaactatctctaccgtctgttccgcaagagtaatcttaagccttttgagagagatatatccaccgaaatctaccaggcgggaagcacaccctgtaacggtgttgagggcttcaattgctattttccactgcagtcttacgggttccaacctaccaacggagtgggctatcagccctacagggtagtcgtgttgtcatttgaactcctgcatgccccagcaactgtttgcggtcccaaaaagagtacgaatttagtgaaaaacaagtgtgtcaatttcaactttaatgggctgacaggcaccggagtgctaactgagagcaacaaaaagttcctccctttccagcagtttggccgggacattgctgataccacagacgccgtacgagatccacaaaccctggagatccttgacataactccgtgctccttcgggggagtgtctgttattacacccggtacgaatacctcgaaccaggtcgctgtgttgtatcaggacgtgaattgtactgaagtccctgttgccatccacgcagatcagctgacaccaacctggcgcgtgtacagcacaggctccaacgtgtttcaaactagagccgggtgcctcatcggagctgagcacgtaaacaattcatatgaatgtgacattcccatcggcgcgggtatttgcgcaagttaccagacccagacgaactctcctaggcgggcccgcagcgtcgcttcccagtcaataatcgcctacaccatgagcctgggggcagaaaattctgtggcctattccaacaatagtattgctatcccaacaaacttcactatcagcgttaccacagaaattcttcccgtgtctatgactaagacctccgtcgattgtacgatgtacatatgcggcgactcaacagagtgtagtaatctgttgctccaatatggcagcttttgcacccagctgaacagagccttaactggaatcgcagtggagcaggataaaaatacacaggaagttttcgcgcaagtgaagcagatttacaaaaccccgcctatcaaggactttgggggattcaacttttcgcagattctgccagatccctccaaaccttctaagaggagcttcatcgaggacctactctttaataaggtaactctggctgatgccggtttcataaaacaatatggcgactgtcttggggatatcgcagcccgtgacttgatttgcgctcagaagttcaacggactgaccgtcctgcccccactcttaacagatgaaatgatcgcccagtacacgtcagcactgcttgctggcaccattacgagtggttggacatttggggccggcgcggccttgcagatccctttcgctatgcaaatggcatatcggtttaatggaataggcgtgacccagaacgtgctctacgagaatcagaaactgattgccaaccagttcaactccgctatcgggaagattcaagactctctaagctccacagcctcagcactgggaaaactccaggacgtcgttaatcagaacgcgcaggccctgaatactcttgtgaagcaattgagcagtaactttggcgctatctcttccgtactgaatgatatattaagccgactcgacaaggtggaagccgaggtccagatcgatagactgattaccggtaggcttcagtcgctgcaaacgtacgtgacacagcagttgatccgcgcagctgagattcgggcctcagcaaacctcgccgctaccaaaatgtctgaatgcgttctggggcagagtaagagagtggacttctgtggaaaaggctatcatctaatgtcctttccccaaagcgcgccacacggtgtcgtgttcctgcatgttacttacgtgccggcccaggagaagaattttaccacagctcctgcaatctgccacgatggcaaagcccacttccccagggaaggggtctttgtatctaacggaactcattggttcgtgacccagcgcaatttttatgagccacagataattacaacggacaacaccttcgttagcggcaattgtgatgtggtcatcgggatcgtgaacaatactgtatacgaccccctccaacctgagctggattccttcaaggaggaacttgacaaatattttaagaaccacacatcaccagatgtggacttgggagatattagtggcatcaatgccagcgtcgttaacattcagaaggaaatagaccgactgaatgaggtggctaaaaacttaaacgaatctctcatcgacctgcaggagcttggtaagtacgagcagtatattaaatggccctggtacatctggctggggttcattgcaggactaatcgccatagtgatggtcaccatcatgctctgctgtatgacttcctgctgttcatgcctgaagggctgttgcagttgtggtagctgctgcaaatttgatgaagacgattccgagcctgtgttgaagggcgttaagctgcattacacatga

SEQ ID NO: 11971 - RNA, 3822 nt, synthetic construct
  misc_feature 1..3822: note = SARS-CoV-2/Shenzhen/SZTH-001/2020__EPI_ISL_406592 spike protein CDS human (1-1273)
  source 1..3822: mol_type = other RNA
atgttcgtgtttctggtcctccttcccctggttagctcccagtgcgtgaacttgaccacaagaactcaattacctccagcctacactaattctttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgagttccgtgtgtacagctccgcgaataactgtacttttgaatatgtgtcacaacctttcctgatggacctggaaggcaagcagggtaattttaaaaacctcagagagttcgtctttaagaacattgatgggtacttcaaaatctacagtaagcacaccccaataaatttagttagggacctgccccagggatttagcgctcttgagcctttggtggatctgccaatcggcattaacatcacacggttccagactctactcgccctgcatcgctcttatcttaccccgggcgactcctcaagcgggtggacagcaggagccgctgcatactatgtaggttacctgcaacccagaacctttttgctcaaatataatgaaaacggcacgattactgatgccgtggactgcgctctggatcctttaagtgagacaaagtgtaccctgaagtctttcactgtcgaaaaagggatctaccagacatccaattttagggtgcagccaaccgagagcatagttcggttccccaacattacgaatctctgcccttttggagaggtgttcaacgccacccgcttcgcgtcggtctatgcatggaatcgaaagagaatctctaactgtgtggccgactactccgtactttacaattcagctagttttagcacattcaaatgctatggcgtttccccaactaagctgaacgacttgtgttttaccaatgtgtacgccgattctttcgtcattaggggtgacgaagtgcggcagatcgcacccgggcaaacaggaaaaatcgctgattataactacaagctaccggacgattttactggctgcgtcattgcctggaatagcaacaacctggactcaaaagtgggcgggaattataactacctctatcgtctgttccgcaagagtaatcttaagccttttgagagagatatatccaccgaaatctaccaggcgggaagcacaccctgtaacggtgttgagggcttcaattgctactttccactgcagtcttatgggttccaacctaccaacggagtgggctaccagccctatagggtagtcgtgttgtcatttgaactcctgcacgccccagcaactgtttgcggtcccaaaaagagtacgaatttagtgaaaaacaagtgtgtcaatttcaactttaatgggctgacaggcaccggagtgctaactgagagcaacaaaaagttcctccctttccagcagtttggccgggacattgctgataccacagacgccgtacgagatccacaaaccctggagatccttgacataactccgtgctccttcgggggagtgtctgttattacacccggtacgaatacctcgaaccaggtcgctgtgttgtaccaggacgtgaattgtactgaagtccctgttgccatccacgcagatcagctgacaccaacctggcgcgtgtatagcacaggctccaacgtgtttcaaactagagccgggtgcctcatcggagctgagcatgtaaacaattcatacgaatgtgacattcccatcggcgcgggtatttgcgcaagttatcagacccagacgaactctcctaggcgggcccgcagcgtcgcttcccagtcaataatcgcctacaccatgagcctgggggcagaaaattctgtggcctactccaacaatagtattgctatcccaacaaacttcactatcagcgttaccacagaaattcttcccgtgtctatgactaagacctccgtcgattgtacgatgtatatatgcggcgactcaacagagtgtagtaatctgttgctccaatacggcagcttttgcacccagctgaacagagccttaactggaatcgcagtggagcaggataaaaatacacaggaagttttcgcgcaagtgaagcagatttataaaaccccgcctatcaaggactttgggggattcaacttttcgcagattctgccagatccctccaaaccttctaagaggagcttcatcgaggacctactctttaataaggtaactctggctgatgccggtttcataaaacaatacggcgactgtcttggggatatcgcagcccgtgacttgatttgcgctcagaagttcaacggactgaccgtcctgcccccactcttaacagatgaaatgatcgcccagtatacgtcagcactgcttgctggcaccattacgagtggttggacatttggggccggcgcggccttgcagatccctttcgctatgcaaatggcataccggtttaatggaataggcgtgacccagaacgtgctctatgagaatcagaaactgattgccaaccagttcaactccgctatcgggaagattcaagactctctaagctccacagcctcagcactgggaaaactccaggacgtcgttaatcagaacgcgcaggccctgaatactcttgtgaagcaattgagcagtaactttggcgctatctcttccgtactgaatgatatattaagccgactcgacaaggtggaagccgaggtccagatcgatagactgattaccggtaggcttcagtcgctgcaaacgtacgtgacacagcagttgatccgcgcagctgagattcgggcctcagcaaacctcgccgctaccaaaatgtctgaatgcgttctggggcagagtaagagagtggacttctgtggaaaaggctaccacctaatgtcctttccccaaagcgcgccacatggtgtcgtgttcctgcacgttacttatgtgccggcccaggagaagaattttaccacagctcctgcaatctgccacgatggcaaagcccatttccccagggaaggggtctttgtatctaacggaactcactggttcgtgacccagcgcaatttttacgagccacagataattacaacggacaacaccttcgttagcggcaattgtgatgtgctcatcgggatcgtcaacaatactgtgtatgaccccctgcaacctgagcttgattccttcaaggaagagttggacaaatactttaagaaccatacatcaccagatgtagacctgggagatattagtggcatcaatgccagcgtggtcaacattcagaaggaaatagaccgattaaatgaggttgctaaaaacctcaacgaatctctgatcgaccttcaggagctgggtaagtatgagcagtacattaaatggccctggtatatctggctagggttcattgcaggactcatcgccatagtgatggtgaccatcatgctgtgctgtatgacttcctgctgttcatgcttgaagggctgttgcagttgtggtagctgctgcaaatttgatgaagacgattccggccctgtcctgaagggggtgaagttacactacacatga

SEQ ID NO: 11972 - RNA, 3822 nt, synthetic construct
  misc_feature 1..3822: note = SARS-CoV-2/Shenzhen/SZTH-004/2020__EPI_ISL_406595 spike protein CDS human (1-1273)
  source 1..3822: mol_type = other RNA
atgttcgtgtttctggtcctccttcccctggttagctcccagtgcgtgaacttgaccacaagaactcaattacctccagcctacacgaatagcttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgagttccgtgtgtacagctccgcgaataactgtacttttgaatatgtgtcacaacctttcctgatggacctggaaggcaagcagggtaattttaaaaacctcagagagttcgtctttaagaacattgatgggtacttcaaaatctacagtaagcacaccccaataaatttagttagggacctgccccagggatttagcgctcttgagcctttggtggatctgccaatcggcattaacatcacacggttccagactctactcgccctgcatcgctcttatcttaccccgggcgactcctcaagcgggtggacagcaggagccgctgcatactatgtaggttacctgcaacccagaacctttttgctcaaatataatgaaaacggcacgattactgatgccgtggactgcgctctggatcctttaagtgagacaaagtgtaccctgaagtctttcactgtcgaaaaagggatctaccagacatccaattttagggtgcagccaaccgagagcatagttcggttccccaacattacgaatctctgcccttttggagaggtgttcaacgccacccgcttcgcgtcggtctatgcatgggaccgaaagagaatctctaattgtgtggcctactactccgtactttataactcagctagttttagcacattcaaatgctacggcgtttccccaactaagctgaatgacttgtgttttaccaacgtgtatgccgattctttcgtcattaggggtgacgaagtgcggcagatcgcacccgggcaaacaggaaaaatcgctgattacaattataagctaccggacgattttactggctgcgtcattgcctggaacagcaataacctggactcaaaagtgggcgggaactacaattatctctaccgtctgttccgcaagagtaaccttaagccttttgagagagatatatccaccgaaatctaccaggcgggaagcacaccctgtaatggtgttgagggcttcaactgctattttccactgcagtcttacgggttccaacctaccaatggagtgggctatcagccctacagggtagtcgtgttgtcatttgaactcctgcacgccccagcaactgtttgcggtcccaaaaagagtacgaacttagtgaaaaataagtgtgtcaacttcaattttaacgggctgacaggcaccggagtgctaactgagagcaataaaaagttcctccctttccagcagtttggccgggacattgctgataccacagacgccgtacgagatccacaaaccctggagatccttgacataactccgtgctccttcgggggagtgtctgttattacacccggtacgaacacctcgaatcaggtcgctgtgttgtatcaggacgtgaactgtactgaagtccctgttgccatccacgcagatcagctgacaccaacctggcgcgtgtacagcacaggctccaatgtgtttcaaactagagccgggtgcctcatcggagctgagcatgtaaacaactcatatgaatgtgacattcccatcggcgcgggtatttgcgcaagttaccagacccagactaattctcctaggcgggcccgcagcgtcgcttcccagtcaataatcgcctacaccatgagcctgggggcagagaactctgtggcctattccaataacagtattgctatcccaacaaatttcactatcagcgttaccacagaaattcttcccgtgtctatgactaagacctccgtcgattgtacgatgtacatatgcggcgactcaacagagtgtagtaacctgttgctccaatatggatctttttgcacccagctgaatagagccttaactggcatcgcagtggagcaggataaaaacacacaggaagttttcgcgcaagtgaagcagatttacaaaaccccgcctatcaaggactttgggggattcaatttttcgcagattctgccagatccctccaaaccttctaagaggagcttcatcgaggacctactctttaacaaggtaactctggctgatgccggtttcataaaacaatatggcgactgtcttggggatatcgcagcccgtgacttgatttgcgctcagaagttcaatggactgaccgtcctgcccccactcttaacagatgaaatgatcgcccagtacacgtcagcactgcttgctggcaccattacgagtggttggacatttggggccggcgcggccttgcagatccctttcgctatgcaaatggcatatcggtttaacggaataggcgtgacccagaatgtgctctacgagaaccagaaactgattgccaatcagttcaactccgctatcgggaagattcaagactctctaagctccacagcctcagcactgggaaaactccaggacgtcgttaaccagaatgcgcaggccctgaacactcttgtgaagcaattgagcagtaattttggcgctatctcttccgtactgaacgatatattaagccgactcgacaaggtggaagccgaggtccagatcgatagactgattaccggtaggcttcagtcgctgcaaacgtacgtgacacagcagttgatccgcgcagctgagattcgggcctcagcaaatctcgccgctaccaaaatgtctgaatgcgttctggggcagagtaagagagtggacttctgtggaaaaggctatcacctaatgtcctttccccaaagcgcgccacatggtgtcgtgttcctgcacgttacttacgtgccggcccaggagaagaactttaccacagctcctgcaatctgccacgatggcaaagcccatttccccagggaaggggtctttgtatctaatggaactcactggttcgtgacccagcgcaacttttatgagccacagataattacaacggacaataccttcgttagcggcaactgtgatgtggtcatcgggatcgtgaataacactgtatacgaccccctccaacctgagctggattccttcaaggaagaacttgacaaatattttaagaatcatacatcaccagatgtggacttgggagatattagtggcatcaacgccagcgtcgttaatattcagaaggaaatagaccgactgaacgaggtggctaaaaatttaaacgaatctctcatcgacctgcaggagcttggtaagtacgagcagtatattaaatggccctggtacatctggctggggttcattgcaggactaatcgccatagtgatggtcaccatcatgctctgctgtatgacttcctgctgttcatgcctgaagggctgttgcagttgtggtagctgctgcaaatttgatgaagacgattccgagcctgtgttgaagggcgttaagctgcactacacatga

SEQ ID NO: 11973 - RNA, 3822 nt, synthetic construct
  misc_feature 1..3822: note = SARS-CoV-2/France/IDF0372/2020__EPI_ISL_406596 spike protein CDS human (1-1273)
  source 1..3822: mol_type = other RNA
atgttcgtgtttctggtcctccttcccctggttagctcccagtgcgtgaacttgaccacaagaactcaattacctccagcctacactaattctttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgagttccgtgtgtacagctccgcgaataactgtacttttgaatatgtgtcacaacctttcctgatggacctggaaggcaagcagggtaattttaaaaacctcagagagttcgtctttaagaacattgatgggtacttcaaaatctacagtaagcacaccccaataaatttagttagggacctgccccagggatttagcgctcttgagcctttggtggatctgccaatcggcattaacatcacacggttccagactctactcgccctgcatcgctcttatcttaccccgggcgactcctcaagcgggtggacagcaggagccgctgcatactatgtaggttacctgcaacccagaacctttttgctcaaatataatgaaaacggcacgattactgatgccgtggactgcgctctggatcctttaagtgagacaaagtgtaccctgaagtctttcactgtcgaaaaagggatctaccagacatccaattttagggtgcagccaaccgagagcatagttcggttccccaacattacgaatctctgcccttttggagaggtgttcaacgccacccgcttcgcgtcggtctatgcatggaatcgaaagagaatctctaactgtgtggccgactactcctttctttacaattcagctagtttcagcacatttaaatgctatggcgtatccccaactaagctgaacgacttgtgtttcaccaatgtttacgccgattcttttgtgattaggggtgacgaagtccggcagatcgcacccgggcaaacaggaaaaatcgctgattataactacaagctaccggacgatttcactggctgcgtgattgcctggaatagcaacaacctggactcaaaagtcggcgggaattataactacctctatcgtctgtttcgcaagagtaatcttaagcctttcgagagagatatatccaccgaaatctaccaggcgggaagcacaccctgtaacggtgtggagggctttaattgctacttcccactgcagtcttatgggtttcaacctaccaacggagttggctaccagccctatagggtggtagtcttgtcattcgaactcctgcacgccccagcaactgtgtgcggtcccaaaaagagtacgaatttagttaaaaacaagtgtgtgaattttaacttcaatgggctgacaggcaccggagtcctaactgagagcaacaaaaagttcctcccttttcagcagttcggccgggacattgctgataccacagacgccgtgcgagatccacaaaccctggagatccttgacataactccgtgctcctttgggggagtatctgtgattacacccggtacgaatacctcgaaccaggttgctgtcttgtaccaggacgtgaattgtactgaagtgcctgtcgccatccacgcagatcagctgacaccaacctggcgcgtttatagcacaggctccaacgtgttccaaactagagccgggtgcctcatcggagctgagcatgtgaacaattcatacgaatgtgacattcccatcggcgcgggtatttgcgcaagttatcagacccagacgaactctcctaggcgggcccgcagcgtagcttcccagtcaataatcgcctacaccatgagcctgggggcagaaaattctgtcgcctactccaacaatagtattgctatcccaacaaactttactatcagcgtgaccacagaaattcttcccgtttctatgactaagacctccgtggattgtacgatgtatatatgcggcgactcaacagagtgtagtaatctgttgctccaatacggcagcttctgcacccagctgaacagagccttaactggaatcgcagtcgagcaggataaaaatacacaggaagtgtttgcgcaagttaagcagatttataaaaccccgcctatcaaggacttcgggggatttaacttctcgcagattctgccagatccctccaaaccttctaagaggagctttatcgaggacctactcttcaataaggtgactctggctgatgccggtttcataaaacaatacggcgactgtcttggggatatcgcagcccgtgacttgatttgcgctcagaagtttaacggactgaccgtactgcccccactcttaacagatgaaatgatcgcccagtatacgtcagcactgcttgctggcaccattacgagtggttggacattcggggccggcgcggccttgcagatcccttttgctatgcaaatggcataccggttcaatggaataggcgtcacccagaacgtgctctatgagaatcagaaactgattgccaaccagtttaactccgctatcgggaagattcaagactctctaagctccacagcctcagcactgggaaaactccaggacgtggtcaatcagaacgcgcaggccctgaatactcttgttaagcaattgagcagtaacttcggcgctatctcttccgtgctgaatgatatattaagccgactcgacaaggtagaagccgaggtgcagatcgatagactgattaccggtaggcttcagtcgctgcaaacgtacgtcacacagcagttgatccgcgcagctgagattcgggcctcagcaaacctcgccgctaccaaaatgtctgaatgcgtgctggggcagagtaagagagttgacttttgtggaaaaggctaccacctaatgtccttcccccaaagcgcgccacatggtgtggtctttctgcacgtgacttatgttccggcccaggagaagaatttcaccacagctcctgcaatctgccacgatggcaaagcccattttcccagggaaggggtgttcgtctctaacggaactcactggtttgtaacccagcgcaatttctacgagccacagataattacaacggacaacaccttcgtgagcggcaattgtgatgttgtgatcgggatcgtcaacaatactgtgtatgaccccctccaacctgagctggattcctttaaggaggaacttgacaaatacttcaagaaccatacatcaccagatgtagacttgggagatattagtggcatcaatgccagcgtggtcaacattcagaaggaaatagaccgactgaatgaggttgctaaaaacttaaacgaatctctcatcgacctgcaggagcttggtaagtatgagcagtacattaaatggccctggtatatctggctggggtttattgcaggactaatcgccatagtgatggtgaccatcatgctctgctgtatgacttcctgctgttcatgcctgaagggctgttgcagttgtggtagctgctgcaaattcgatgaagacgattccgagcctgtcttgaagggcgtgaagctgcactacacatga

SEQ ID NO: 11974 - RNA, 3822 nt, synthetic construct
  misc_feature 1..3822: note = SARS-CoV-2/Australia/VIC01/2020__EPI_ISL_406844 spike protein CDS human (1-1273)
  source 1..3822: mol_type = other RNA
atgttcgtgtttctggtcctccttcccctggttagctcccagtgcgtgaacttgaccacaagaactcaattacctccagcctacaccaattctttcacgaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgagttccgtgtgtacagctccgcgaataactgtacttttgaatatgtgtcacaacctttcctgatggacctggaaggcaagcagggtaattttaaaaacctcagagagttcgtctttaagaacattgatgggtacttcaaaatctacagtaagcacaccccaataaatttagttagggacctgccccagggatttagcgctcttgagcctttggtggatctgccaatcggcattaacatcacacggttccagactctactcgccctgcatcgcagatatcttaccccgggcgactcttcctcagggtggacagcaggagccgctgcatactatgtaggttacctgcaacccaggacctttttgctcaaatataatgaaaacggcacgattactgatgccgtggactgcgctctggatcctttaagcgagacaaagtgtaccctgaagagtttcactgtcgaaaaagggatctaccagacatctaattttcgggtgcagccaaccgagtccatagttcgcttccccaacattacgaatctctgcccttttggagaggtgttcaacgccacccgattcgcgagcgtctatgcatggaatagaaagaggatctcgaactgtgtggccgactactctgtactttacaattccgcttcatttagtacattcaaatgctatggcgttagcccaactaagctgaacgacttgtgttttaccaatgtgtacgccgattccttcgtcattcggggtgacgaagtgcgtcagatcgcacccgggcaaacaggaaaaatcgctgattataactacaagctaccggacgattttactggctgcgtcattgcctggaactctaataacctggacagcaaagtgggcgggaattataactacctctatcgcctgttcagaaagtcaaatcttaagccttttgagagggatataagtaccgaaatctaccaggcgggatccacaccctgtaacggtgttgagggcttcaattgctactttccactgcagagctatgggttccaacctaccaacggagtgggctaccagccctatcgggtagtcgtgttgtcttttgaactcctgcacgccccagcaactgtttgcggtcccaaaaagtcaacgaatttagtgaaaaacaagtgtgtcaatttcaactttaatgggctgacaggcaccggagtgctaactgagagtaacaaaaagttcctccctttccagcagtttggccgagacattgctgataccacagacgccgtacgcgatccacaaaccctggagatccttgacataactccgtgcagcttcgggggagtgtccgttattacacccggtacgaatacctctaaccaggtcgctgtgttgtaccaggacgtgaattgtactgaagtccctgttgccatccacgcagatcagctgacaccaacctggagagtgtattcgacaggcagcaacgtgtttcaaactagggccgggtgcctcatcggagctgagcatgtaaacaattcctacgaatgtgacattcccatcggcgcgggtatttgcgcatcatatcagacccagacgaacagtcctcggcgcgccagatctgtcgctagccagtccataatcgcctacaccatgtcactgggggcagagaatagcgtggcctactctaacaattccattgctatcccaacaaacttcactatcagtgttaccacagaaattcttcccgtgagcatgactaagacctctgtcgattgtacgatgtatatatgcggcgactccacagagtgttcaaatctgttgctccaatacggaagtttttgcacccagctgaacagggccttaactggcatcgcagtggagcaggataaaaatacacaggaagttttcgcgcaagtgaagcagatttataaaaccccgcctatcaaggactttgggggattcaactttagccagattctgccagatccctcgaaaccttccaagcgttctttcatcgaggacctactctttaataaggtaactctggctgatgccggtttcataaaacaatacggcgactgtcttggggatatcgcagcccgggacttgatttgcgctcagaagttcaacggactgaccgtcctccctccactgttaacagatgaaatgatcgcccagtatacgagcgcactgcttgctggcaccattacttcaggttggacatttggggccggcgcggccttgcagatccctttcgctatgcaaatggcataccgatttaatggaataggcgtgacccagaacgtgctctatgagaatcagaaactgattgccaaccagttcaacagtgctatcgggaagattcaagactccctatctagcacagcctccgcactgggaaaactccaggacgtcgttaatcagaacgcgcaggccctgaatactcttgtgaagcaattgtcaagcaactttggcgctatcagttctgtactgaatgatatattatccagactcgacaaggtggaagccgaggtccagatcgataggctgattaccggtcgccttcagagcctgcaaacgtacgtgacacagcagttgatccgggcagctgagattagagcctcggcaaacctcgccgctaccaaaatgtcagaatgcgttctggggcagtctaagagggtggacttctgtggaaaaggctaccacctaatgagttttccccaatccgcgccacatggtgtcgtgttcctgcacgttacttatgtgccggcccaggagaagaattttaccacagcacccgctatctgccacgatggcaaagcccatttcccccgcgaaggggtctttgtaagcaacggaactcactggttcgtgacccagcgaaatttttacgagccacagataattacaacggacaacaccttcgtttctggcaattgtgatgtggtcatcgggatcgtgaacaatactgtatatgaccccctccaacctgagctggatagcttcaaggaagaacttgacaaatactttaagaaccatacatccccagatgtggacttgggagatatttcaggcatcaatgccagtgtcgttaacattcagaaggaaatagaccggctgaatgaggtggctaaaaacttaaacgaaagcctcatcgacctgcaggagcttggtaagtatgagcagtacattaaatggccctggtatatctggctggggttcattgcaggactaatcgccatagtgatggtcaccatcatgctctgctgtatgacttcttgctgttcctgcctgaagggctgttgctcatgtggtagttgctgcaaatttgatgaagacgatagcgagcctgtgttgaagggcgttaagctgcactacacatga

SEQ ID NO: 11975 - RNA, 3822 nt, synthetic construct
  misc_feature 1..3822: note = SARS-CoV-2/Germany/BavPat1/2020__EPI_ISL_406862 spike protein CDS human (1-1273)
  source 1..3822: mol_type = other RNA
atgttcgtgtttctggtcctccttcccctggttagctcccagtgcgtgaacttgaccacaagaactcaattacctccagcctacactaattctttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgagttccgtgtgtacagctccgcgaataactgtacttttgagtatgtgtcacaacctttcctgatggacctggaaggcaagcagggtaattttaaaaacctcagagagttcgtctttaagaacattgatgggtacttcaaaatctacagtaagcacaccccaataaatttagttagggacctgccccagggatttagcgctcttgagcctttggtggatctgccaatcggcattaacatcacacggttccagactctactcgccctgcatcgctcttatcttaccccgggcgactcctcaagcgggtggacagcaggagccgctgcatactatgtaggttacctgcaacccagaacctttttgctcaaatataatgaaaacggcacgattactgatgccgtggactgcgctctggatcctttaagtgagacaaagtgtaccctgaagtctttcactgtcgaaaaagggatctaccagacatccaattttagggtgcagccaaccgagagcatagttcggttccccaacattacgaatctctgcccttttggagaggtgttcaacgccacccgcttcgcgtcggtctatgcatggaatcgaaagagaatctctaactgtgtggccgactactccgtactttacaattcagctagttttagcacattcaaatgctatggcgtttccccaactaagctgaacgacttgtgttttaccaatgtgtacgccgattctttcgtcattaggggtgacgaagtgcggcagatcgcacccgggcaaacaggaaaaatcgctgattataactacaagctaccggacgattttactggctgcgtcattgcctggaatagcaacaacctggactcaaaagtgggcgggaattataactacctctatcgtctgttccgcaagagtaatcttaagccttttgagagagatatatccaccgaaatctaccaggcgggaagcacaccctgtaacggtgttgagggcttcaattgctactttccactgcagtcttatgggttccaacctaccaacggagtgggctaccagccctatagggtagtcgtgttgtcatttgaactcctgcacgccccagcaactgtttgcggtcccaaaaagagtacgaatttagtgaaaaacaagtgtgtcaatttcaactttaatgggctgacaggcaccggagtgctaactgagagcaacaaaaagttcctccctttccagcagtttggccgggacattgctgataccacagacgccgtacgagatccacaaaccctggagatccttgacataactccgtgctccttcgggggagtgtctgttattacacccggtacgaatacctcgaaccaggtcgctgtgttgtaccagggcgtgaattgtactgaagtccctgttgccatccacgcagaccagctgacaccaacctggcgcgtgtatagcacagggtccaacgtgtttcaaactagagccggatgcctcatcggcgctgagcatgtaaacaattcatacgaatgtgatattcccatcggtgcggggatttgcgcaagttatcagacccagacgaactctcctaggcgggcccgcagcgtcgcttcccagtcaataatcgcctacaccatgagcctgggcgcagaaaattctgtggcctactccaacaatagtattgctatcccaacaaacttcactatcagcgttaccacagaaattcttcccgtgtctatgactaagacctccgtcgactgtacgatgtatatatgcggagattcaacagagtgtagtaatctgttgctccaatacggcagcttttgcacccagctgaacagagccttaactgggatcgcagtggagcaggacaaaaatacacaggaagttttcgcgcaagtgaagcagatttataaaaccccgcctatcaaggattttggaggtttcaacttttcgcagattctgccagacccctccaaaccttctaagaggagcttcatcgaggatctactctttaataaggtaactctggctgacgccggcttcataaaacaatacggggattgtcttggagacatcgcagcccgtgatttgatttgcgctcagaagttcaacggcctgaccgtcctgcccccactcttaacagacgaaatgatcgcccagtatacgtcagcactgcttgctggtaccattacgagtgggtggacatttggcgccggagcggccttgcagatccctttcgctatgcaaatggcataccggtttaatggcataggggtgacccagaacgtgctctatgagaatcagaaactgattgccaaccagttcaactccgctatcggaaagattcaagattctctaagctccacagcctcagcactgggcaaactccaggacgtcgttaatcagaacgcgcaggccctgaatactcttgtgaagcaattgagcagtaactttggtgctatctcttccgtactgaatgacatattaagccgactcgataaggtggaagccgaggtccagatcgacagactgattaccgggaggcttcagtcgctgcaaacgtacgtgacacagcagttgatccgcgcagctgagattcgggcctcagcaaacctcgccgctaccaaaatgtctgaatgcgttctgggacagagtaagagagtggatttctgtggcaaaggttaccacctaatgtcctttccccaaagcgcgccacatggcgtcgtgttcctgcacgttacttatgtgccggcccaggagaagaattttaccacagctcctgcaatctgccacgacgggaaagcccatttccccagggaaggagtctttgtatctaacggcactcactggttcgtgacccagcgcaatttttacgagccacagataattacaacggataacaccttcgttagcgggaattgtgacgtggtcatcggaatcgtgaacaatactgtatatgatcccctccaacctgagctggactccttcaaggaagaacttgataaatactttaagaaccatacatcaccagacgtggatttgggcgacattagtggtatcaatgccagcgtcgttaacattcagaaggaaatagatcgactgaatgaggtggctaaaaacttaaacgaatctctcatcgacctgcaggagcttgggaagtatgagcagtacattaaatggccctggtatatctggctgggattcattgcaggcctaatcgccatagtgatggtcaccatcatgctctgctgtatgacttcctgctgttcatgcctgaagggttgttgcagttgtggcagctgctgcaaatttgacgaagatgactccgagcctgtgttgaagggggttaagctgcactacacatga

SEQ ID NO: 11976 - RNA, 3822 nt, synthetic construct
  misc_feature 1..3822: note = SARS-CoV-2/Wuhan/HBCDC-HB-02/2020__EPI_ISL_412978 spike protein CDS human (1-1273)
  source 1..3822: mol_type = other RNA
atgttcgtgtttctggtcctccttcccctggttagctcccagtgcgtgaacttgaccacaagaactcaattacctccagcctacactaattctttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgagttccgtgtgtacagctccgcgaataactgtacttttgagtatgtgtcacaacctttcctgatggacctggaaggcaagcagggtaattttaaaaacctcagagagttcgtctttaagaacattgatgggtacttcaaaatctacagtaagcacaccccaataaatttagttagggacctgccccagggatttagcgctcttgagcctttggtggatctgccaatcggcattaacatcacacggttccagactctactcgccctgcatcgctcttatcttaccccgggcgactcctcaagcgggtggacagcaggagccgctgcatactatgtaggttacctgcaacccagaacctttttgctcaaatataatgaaaacggcacgattactgatgccgtggactgcgctctggatcctttaagtgagacaaagtgtaccctgaagtctttcactgtcgaaaaagggatctaccagacatccaattttagggtgcagccaaccgagagcatagttcggttccccaacattacgaatctctgcccttttggagaggtgttcaacgccacccgcttcgcgtcggtctatgcatggaatcgaaagagaatctctaactgtgtggccgactactccgtactttacaattcagctagttttagcacattcaaatgctatggcgtttccccaactaagctgaacgacttgtgttttaccaatgtgtacgccgattctttcgtcattaggggtgacgaagtgcggcagatcgcacccgggcaaacaggaaaaatcgctgattataactacaagctaccggacgattttactggctgcgtcattgcctggaatagcaacaacctggactcaaaagtgggcgggaattataactacctctatcgtctgttccgcaagagtaatcttaagccttttgagagagatatatccaccgaaatctaccaggcgggaagcacaccctgtaacggtgttgagggcttcaattgctactttccactgcagtcttatgggttccaacctaccaacggagtgggctaccagccctatagggtagtcgtgttgtcatttgaactcctgcacgccccagcaactgtttgcggtcccaaaaagagtacgaatttagtgaaaaacaagtgtgtcaatttcaactttaatgggctgacaggcaccggagtgctaactgagagcaacaaaaagttcctccctttccagcagtttggccgggacattgctgataccacagacgccgtacgagatccacaaaccctggagatccttgacataactccgtgctccttcgggggagtgtctgttattacacccggtacgaatacctcgaaccaggtcgctgtgttgtaccaggacgtgaattgtactgaagtccctgttgccatccacgcagatcagctgacaccaacctggcgcgtgtatagcacaggctccaacgtgtttcaaactagagccgggtgcctcatcggagctgagcatgtaaacaattcatacgaatgtgacattcccatcggcgcgggtatttgcgcaagttatcagacccagacgaactctcctaggcgggcccgcagcgtcgcttcccagtcaataatcgcctacaccatgagcctgggggcagaaaattctgtggcctactccaacaatagtattgctatcccaacaaacttcactatcagcgttaccacagaaattcttcccgtgtctatgactaagacctccgtcgattgtacgatgtatatatgcggcgactcaacagagtgtagtaattttctgttgcaatacggcagcttctgcacccagctcaacagagccctgactggaatcgcagtggagcaggataaaaatacacaggaagtttttgcgcaagtgaagcagatttataaaaccccgcctatcaaggacttcgggggatttaacttctcgcagattttaccagatccctccaaaccttctaagaggagctttatcgaggacctgctattcaataaggtaactctcgctgatgccggtttcataaaacaatacggcgactgtctgggggatatcgcagcccgtgaccttatttgcgctcagaagtttaacggattgaccgtcctgcccccactcctgacagatgaaatgatcgcccagtatacgtcagcattactggctggcaccattacgagtggttggacattcggggccggcgcggcccttcagatcccttttgctatgcaaatggcataccggttcaatggaataggcgtgacccagaacgtgttgtatgagaatcagaaactcattgccaaccagtttaactccgctatcgggaagattcaagactctctgagctccacagcctcagcactaggaaaactgcaggacgtcgttaatcagaacgcgcaggccctcaatactctggtgaagcaacttagcagtaacttcggcgctatctcttccgtattgaatgatatactgagccgattagacaaggtggaagccgaggtccagatcgatagactcattaccggtaggctgcagtcgcttcaaacgtacgtgacacagcagctgatccgcgcagctgagattcgggcctcagcaaacttggccgctaccaaaatgtctgaatgcgttctcgggcagagtaagagagtggacttttgtggaaaaggctaccacctgatgtccttcccccaaagcgcgccacatggtgtcgtgtttctacacgttacttatgtgccggcccaggagaagaatttcaccacagctcctgcaatctgccacgatggcaaagcccattttcccagggaaggggtcttcgtatctaacggaactcactggtttgtgacccagcgcaatttctacgagccacagataattacaacggacaacaccttcgttagcggcaattgtgatgtggtcatcgggatcgtgaacaatactgtatatgaccccctgcaacctgagctcgattcctttaaggaagaactggacaaatacttcaagaaccatacatcaccagatgtggaccttggagatattagtggcatcaatgccagcgtcgttaacattcagaaggaaatagaccgattgaatgaggtggctaaaaacctgaacgaatctttaatcgacctccaggagctgggtaagtatgagcagtacattaaatggccctggtatatctggcttgggtttattgcaggactgatcgccatagtgatggtcaccatcatgctatgctgtatgacttcctgctgttcatgcctcaagggctgttgcagttgtggtagctgctgcaaattcgatgaagacgattccgagcctgtgctgaagggcgttaagttgcactacacatga

SEQ ID NO: 11977 - RNA, 3822 nt, synthetic construct
  misc_feature 1..3822: note = SARS-CoV-2/Australia/QLD02/2020__EPI_ISL_407896 spike protein CDS human (1-1273)
  source 1..3822: mol_type = other RNA
atgttcgtgtttctggtcctccttcccctggttagctcccagtgcgtgaacttgaccacaagaactcaattacctccagcctacactaattctttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgagttccgtgtgtacagctccgcgaataactgtacttttgaatatgtgtcacaacctttcctgatggacctggaaggcaagcagggtaattttaaaaacctcagagagttcgtctttaagaacattgatgggtacttcaaaatctacagtaagcacaccccaataaatttagttagggacctgccccagggatttagcgctcttgagcctttggtggatctgccaatcggcattaacatcacacggttccagactctactcgccctgcatcgctcttatcttaccccgggcgactcctcaagcgggtggacagcaggagccgctgcatactatgtaggttacctgcaacccagaacctttttgctcaaatataatgaaaacggcacgattactgatgccgtggactgcgctctggatcctttaagtgagacaaagtgtaccctgaagtctttcactgtcgaaaaagggatctaccagacatccaattttagggtgcagccaaccgagagcatagttcggttccccaacattacgaatctctgcccttttggagaggtgttcaacgccacccgcttcgcgtcggtctatgcatggaatcgaaagagaatctctaactgtgtggccgactactccgtactttacaattcagctagttttagcacattcaaatgctatggcgtttccccaactaagctgaacgacttgtgttttaccaatgtgtacgccgattctttcgtcattaggggtgacgaagtgcggcagatcgcacccgggcaaacaggaaaaatcgctgattataactacaagctaccggacgattttactggctgcgtcattgcctggaatagcaacaacctggactcaaaagtgggcgggaattataactacctctatcgtctgttccgcaagagtaatcttaagccttttgagagagatatatccaccgaaatctaccaggcgggaagcacaccctgtaacggtgttgagggcttcaattgctactttccactgcagtcttatgggttccaacctaccaacggagtgggctaccagccctatagggtagtcgtgttgtcatttgaactcctgcacgccccagcaactgtttgcggtcccaaaaagagtacgaatttagtgaaaaacaagtgtgtcaatttcaactttaatgggctgacaggcaccggagtgctaactgagagcaacaaaaagttcctccctttccagcagtttggccgggacattgctgataccacagacgccgtacgagatccacaaaccctggagatccttgacataactccgtgctccttcgggggagtgtctgttattacacccggtacgaatacctcgaaccaggtcgctgtgttgtaccaggacgtgaattgtactgaagtccctgttgccatccacgcagatcagctgacaccaacctggcgcgtgtatagcacaggctccaacgtgtttcaaactagagccgggtgcctcatcggagctgagcatgtaaacaattcatacgaatgtgacattcccatcggcgcgggtatttgcgcaagttatcagacccagacgaactctcctaggcgggcccgcagcgtcgcttcccagtcaataatcgcctacaccatgagcctgggggcagaaaattctgtggcctactccaacaatagtattgctatcccaacaaacttcactatcagcgttaccacagaaattcttcccgtgtctatgactaagacctccgtcgattgtacgatgtatatatgcggcgactcaacagagtgtagtaatctgttgctccaatacggcagcttttgcacccagctgaacagagccttaactggaatcgcagtggagcaggataaaaatacacaggaagttttcgcgcaagtgaagcagatttataaaaccccgcctatcaaggactttgggggattcaacttttcgcagattctgccagatccctccaaaccttctaagaggagcttcatcgaggacctactctttaataaggtaactctggctgatgccggtttcataaaacaatacggcgactgtcttggggatatcgcagcccgtgacttgatttgcgctcagaagttcaacggactgaccgtcctgcccccactcttaacagatgaaatgatcgcccagtatacgtcagcactgcttgctggcaccattacgagtggttggacatttggggccggcgcggccttgcagatccctttcgctatgcaaatggcataccggtttaatggaataggcgtgacccagaacgtgctctatgagaatcagaaactgattgccaaccagttcaactccgctatcgggaagattcaagactctctaagctccacagcctcagcactgggaaaactccaggacgtcgttaatcagaacgcgcaggccctgaatactcttgtgaagcaattgagcagtaactttggcgctatctcttccgtactgaatgatatattaagccgactcgacaaggtggaagccgaggtccagatcgatagactgattaccggtaggcttcagtcgctgcaaacgtacgtgacacagcagttgatccgcgcagctgagattcgggcctcagcaaacctcgccgctaccaaaatgtctgaatgcgttctggggcagagtaagagagtggacttctgtggaaaaggctaccacctaatgtcctttccccaaagcgcgccacatggtgtcgtgttcctgcacgttacttatgtgccggcccaggagaagaattttaccacagctcctgcaatctgccacgatggcaaagcccatttccccagggaaggggtctttgtatctaacggaactcactggttcgtgacccagcgcaatttttacgagccacagataattacaacggacaacaccttcgttagcggcaattgtgatgtggtcatcgggatcgtgaacaatactgtatatgaccccctccaactggagcttgattccttcaaggaagagttggacaaatactttaagaaccatacatcacctgatgtggacctgggagatattagtggcatcaatgccagcgtcgttaacattcagaaggaaatagaccgattaaatgaggtggctaaaaacctcaacgaatctctgatcgaccttcaggagctgggtaagtatgagcagtacattaaatggccatggtatatctggctagggttcattgcaggactcatcgccatagtgatggtcaccatcatgctgtgctgtatgacttcctgctgttcatgcttgaagggctgttgcagttgtggtagctgctgcaaatttgatgaagacgattccgagcccgtgctgaagggcgttaagttacactacacatga

SEQ ID NO: 11978 - RNA, 3822 nt, synthetic construct
  misc_feature 1..3822: note = SARS-CoV-2/India/1-31/2020__EPI_ISL_413523 spike protein CDS human (1-1273)
  source 1..3822: mol_type = other RNA
atgttcgtgtttctggtcctccttcccctggttagctcccagtgcgtgaacttgaccacaagaactcaattacctccagcctacactaattctttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgagttccgtgtgtacagctccgcgaataactgtacttttgaatatgtgtcacaacctttcctgatggacctggaaggcaagcagggtaattttaaaaacctcagagagttcgtctttaagaacattgatgggtacttcaaaatctacagtaagcacaccccaataaatttagttagggacctgccccagggatttagcgctcttgagcctttggtggatctgccaatcggcattaacatcacacggttccagactctactcgccctgcatcgctcttatcttaccccgggcgactcctcaagcgggtggacagcaggagccgctgcatactatgtaggttacctgcaacccagaacctttttgctcaaatataatgaaaacggcacgattactgatgccgtggactgcgctctggatcctttaagtgagacaaagtgtaccctgaagtctttcactgtcgaaaaagggatctaccagacatccaattttagggtgcagccaaccgagagcatagttcggttccccaacattacgaatctctgcccttttggagaggtgttcaacgccacccgcttcgcgtcggtctatgcatggaatcgaaagagaatctctaactgtgtggccgactactccgtactttacaattcagctagttttagcacattcaaatgctatggcgtttccccaactaagctgaacgacttgtgttttaccaatgtgtacgccgattctttcgtcattaggggtgacgaagtgcggcagatcgcacccgggcaaacaggaaaaatcgctgattataactacaagctaccggacgattttactggctgcgtcattgcctggaatagcaacaacctggactcaaaagtgggcgggaattataactacctctatcgtctgttccgcaagagtaatcttaagccttttgagagagatatatccaccgaaatctaccaggcgggaagcacaccctgtaacggtgttgagggcttcaattgctactttccactgcagtcttatgggttccaacctaccaacggagtgggctaccagccctatagggtagtcgtgttgtcatttgaactcctgcacgccccagcaactgtttgcggtcccaaaaagagtacgaatttagtgaaaaacaagtgtgtcaatttcaactttaatgggctgacaggcaccggagtgctaactgagagcaacaaaaagttcctccctttccagcagtttggccgggacattgctgataccacagacgccgtacgagatccacaaaccctggagatccttgacataactccgtgctccttcgggggagtgtctgttattacacccggtacgaatacctcgaaccaggtcgctgtgttgtaccaggacgtgaattgtactgaagtccctgttgccatccacgcagatcagctgacaccaacctggcgcgtgtatagcacaggctccaacgtgtttcaaactagagccgggtgcctcatcggagctgagcatgtaaacaattcatacgaatgtgacattcccatcggcgcgggtatttgcgcaagttatcagacccagacgaactctcctaggcgggcccgcagcgtcgcttcccagtcaataatcgcctacaccatgagcctgggggcagaaaattctgtggcctactccaacaatagtattgctatcccaacaaacttcactatcagcgttaccacagaaattcttcccgtgtctatgactaagacctccgtcgattgtacgatgtatatatgcggcgactcaacagagtgtagtaatctgttgctccaatacggcagcttttgcacccagctgaacagagccttaactggaatcgcagtggagcaggataaaaatacacaggaagttttcgcgcaagtgaagcagatttataaaaccccgcctatcaaggactttgggggattcaacttttcgcagattctgccagatccctccaaaccttctaagaggagcttcatcgaggacctactctttaataaggtaactctggctgatgccggtttcataaaacaatacggcgactgtcttggggatatcgcagcccgtgacttgatttgcgctcagaagttcaacggactgaccgtcctgcccccactcttaacagatgaaatgatcgcccagtatacgtcagcactgcttgctggcaccattacgagtggttggacatttggggccggcgcggccttgcagatccctttcgctatgcaaatggcataccggtttaatggaataggcgtgacccagaacgtgctctatgagaatcagaaactgattgccaaccagttcaactccgtcatcgggaagattcaagactctctaagctccacagcttcagccctgggaaaactccaggacgttgtgaatcagaacgcacaggcgctgaatactcttgtaaagcaattgagcagtaactttggcgccatctcttccgtgctgaatgatatattaagccgactcgacaaggtcgaagctgaggtgcagatcgatagactgattaccggtaggcttcagtcgctgcaaacgtacgttacacagcagttgatccgcgccgcagagattcgggcttcagccaacctcgcagccaccaaaatgtctgaatgcgtgctggggcagagtaagagagtcgacttctgtggaaaaggctaccacctaatgtcctttccccaaagcgctccacatggtgtggttttcctgcacgtgacttatgtcccggcgcaggagaagaattttaccacagcccctgcaatctgccacgatggcaaagctcatttccccagggaaggggtatttgtgtctaacggaactcactggttcgttacccagcgcaatttttacgagccacagataattacaacggacaacaccttcgtgagcggcaattgtgatgtcgtgatcgggatcgtaaacaatactgtgtatgaccccctccaacctgagctggattccttcaaggaggaacttgacaaatactttaagaaccatacatcaccagatgtcgacttgggagatattagtggcatcaatgccagcgttgtgaacattcagaaggaaatagaccgactgaatgaggtggccaaaaacttaaacgaatctctcatcgacctgcaggagcttggtaagtatgagcagtacattaaatggccctggtatatctggctggggttcattgctggactaatcgcaatagtcatggtgaccatcatgctctgctgtatgacttcctgctgttcatgcctgaagggctgttgcagttgtggtagctgctgcaaatttgatgaagacgattccgagcctgttttgaagggcgtaaagctgcactacacatga

SEQ ID NO: 11979 - RNA, 3822 nt, synthetic construct
  misc_feature 1..3822: note SARS-CoV-2/Guangdong/GD2020087-P0008/2020__EPI_ISL_413863 spike protein CDS human (1-1273)
  source 1..3822: mol_type = other RNA
atgttcgtgtttctggtcctccttcccctggttagctcccagtgcgtgaacttgaccacaagaactcaattacctccagcctacactaattctttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggaatctgagttccgtgtgtacagctccgcgaataactgtacttttgaatatgtgtcacaacctttcctgatggacctggaaggcaagcagggtaattttaaaaacctcagagagttcgtctttaagaacattgatgggtacttcaaaatctacagtaagcacaccccaataaatttagttagggacctgccccagggatttagcgctcttgagcctttggtggatctgccaatcggcattaacatcacacggttccagactctactcgccctgcatcgctcttatcttaccccgggcgactcctcaagcgggtggacagcaggagccgctgcatactatgtaggttacctgcaacccagaacctttttgctcaaatataatgaaaacggcacgattactgatgccgtggactgcgctctggatcctttaagtgagacaaagtgtaccctgaagtctttcactgtcgaaaaagggatctaccagacatccaattttagggtgcagccaaccgagagcatagttcggttccccaacattacgaatctctgcccttttggagaggtgttcaacgccacccgcttcgcgtcggtctatgcatggaatcgaaagagaatctctaactgtgtggccgactactccgtactttacaattcagctagttttagcacattcaaatgctatggcgtttccccaactaagctgaacgacttgtgttttaccaatgtgtacgccgattctttcgtcattaggggtgacgaagtgcgggagatcgcacccgggcagacaggaaaaatcgctgattataactacaagctaccggacgattttactggctgcgtcattgcctggaatagcaacaacctggactcaaaagtgggcgggaattataactacctctatcgtctgttccgcaagagtaatcttaagccttttgaaagagatatatccaccgagatctaccaagcgggaagcacaccctgtaacggtgttgaaggcttcaattgctactttccactgcagtcttatgggttccagcctaccaacggagtgggctaccaaccctatagggtagtcgtgttgtcatttgagctcctgcacgccccagcaactgtttgcggtcccaaaaagagtacgaatttagtgaaaaacaagtgtgtcaatttcaactttaatgggctgacaggcaccggagtgctaactgagagcaacaaaaagttcctccctttccagcagtttggccgggacattgctgataccacagacgccgtacgagatccacagaccctggaaatccttgacataactccgtgctccttcgggggagtgtctgttattacacccggtacgaatacctcgaaccaagtcgctgtgttgtaccaggacgtgaattgtactgaggtccctgttgccatccacgcagatcagctgacaccaacctggcgcgtgtatagcacaggctccaacgtgtttcagactagagccgggtgcctcatcggagctgaacatgtaaacaattcatacgagtgtgacattcccatcggcgcgggtatttgcgcaagttatcaaacccagacgaactctcctaggcgggcccgcagcgtcgcttcccagtcaataatcgcctacaccatgagcctgggggcagaaaattctgtggcctactccaacaatagtattgctatcccaacaaacttcactatcagcgttaccacagagattcttcccgtgtctatgactaagacctccgtcgattgtacgatgtatatatgcggcgactcaacagagtgtagtaatctgttgctccagtacggcagcttttgcacccaactgaacagagccttaactggaatcgcagtggaacaggataaaaatacacaggaggttttcgcacaggtgaagcaaatttataaaaccccgcctatcaaggactttgggggattcaacttttcgcagattctgccagatccctccaaaccttctaagaggagcttcatcgaagacctactctttaataaggtaactctggctgatgccggtttcataaaacagtacggcgactgtcttggggatatcgcagcccgtgacttgatttgcgctcaaaagttcaacggactgaccgtcctgcccccactcttaacagatgagatgatcgcccagtatacgtcagcactgcttgctggcaccattacgagtggttggacatttggggccggcgcggccttgcagatccctttcgctatgcagatggcataccggtttaatggaataggcgtgacccaaaacgtgctctatgaaaatcagaaactgattgccaaccagttcaactccgctatcgggaagattcaggactctctaagctccacagcctcagcactgggaaaactccaagacgtcgttaatcagaacgcgcaggccctgaatactcttgtgaagcagttgagcagtaactttggcgctatctcttccgtactgaatgatatattaagccgactcgacaaggtggaggccgaggtccaaatcgatagactgattaccggtaggcttcagtcgctgcagacgtacgtgacacaacagttgatccgcgcagctgaaattcgggcctcagcaaacctcgccgctaccaaaatgtctgagtgcgttctggggcagagtaagagagtggacttctgtggaaaaggctaccacctaatgtcctttccccagagcgcgccacatggtgtcgtgttcctgcacgttacttatgtgccggcccaagaaaagaattttaccacagcgcctgctatctgccacgatggcaaagcccatttccccagggagggggtctttgtatctaacggaactcactggttcgtgacccagcgcaatttttacgagccacagataattacaacggacaacaccttcgttagcggcaattgtgatgtggtcatcgggatcgtgaacaatactgtatatgaccccctccagcctgaactggattccttcaaggaggaacttgacaaatactttaagaaccatacatcaccagatgtggacttgggagatattagtggcatcaatgccagcgtcgttaacattcaaaaggagatagaccgactgaatgaagtggctaaaaacttaaacgagtctctcatcgacctgcaggagcttggtaagtatgaacagtacattaaatggccctggtatatctggctggggttcattgcaggactaatcgccatagtgatggtcaccatcatgctctgctgtatgacttcctgctgttcatgcctgaagggctgttgcagttgtggtagctgctgcaaatttgatgaggacgattccgaacctgtgttgaagggcgttaagctgcactacacatga

SEQ ID NO: 11980 - RNA, 3822 nt, synthetic construct
  misc_feature 1..3822: note = SARS-CoV-2/Sweden/01/2020__EPI_ISL_411951 spike protein CDS human (1-1273)
  source 1..3822: mol_type = other RNA
atgttcgtgtttctggtcctccttcccctggttagctcccagtgcgtgaacttgaccacaagaactcaattacctccagcctacactaattctttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgagttccgtgtgtacagctccgcgaataactgtacttttgaatatgtgtcacaacctttcctgatggacctggaaggcaagcagggtaattttaaaaacctcagagagttcgtctttaagaacattgatgggtacttcaaaatctacagtaagcacaccccaataaatttagttagggacctgccccagggatttagcgctcttgagcctttggtggatctgccaatcggcattaacatcacacggttccagactctactcgccctgcatcgctcttatcttaccccgggcgactcctcaagcgggtggacagcaggagccgctgcatactatgtaggttacctgcaacccagaacctttttgctcaaatataatgaaaacggcacgattactgatgccgtggactgcgctctggatcctttaagtgagacaaagtgtaccctgaagtctttcactgtcgaaaaagggatctaccagacatccaattttagggtgcagccaaccgagagcatagttcggttccccaacattacgaatctctgcccttttggagaggtgttcaacgccacccgcttcgcgtcggtctatgcatggaatcgaaagagaatctctaactgtgtggccgactactccgtactttacaattcagctagttttagcacattcaaatgctatggcgtttccccaactaagctgaacgacttgtgttttaccaatgtgtacgccgattctttcgtcattaggggtgacgaagtgcggcagatcgcacccgggcaaacaggaaaaatcgctgattataactacaagctaccggacgattttactggctgcgtcattgcctggaatagcaacaacctggactcaaaagtgggcgggaattataactacctctatcgtctgttccgcaagagtaatcttaagccttttgagagagatatatccaccgaaatctaccaggcgggaagcacaccctgtaacggtgttgagggcttcaattgctactttccactgcagtcttatgggttccaacctaccaacggagtgggctaccagccctatagggtagtcgtgttgtcatttgaactcctgcacgccccagcaactgtttgcggtcccaaaaagagtacgaatttagtgaaaaacaagtgtgtcaatttcaactttaatgggctgacaggcaccggagtgctaactgagagcaacaaaaagttcctccctttccagcagtttggccgggacattgctgataccacagacgccgtacgagatccacaaaccctggagatccttgacataactccgtgctccttcgggggagtgtctgttattacacccggtacgaatacctcgaaccaggtcgctgtgttgtaccaggacgtgaattgtactgaagtccctgttgccatccacgcagatcagctgacaccaacctggcgcgtgtatagcacaggctccaacgtgtttcaaactagagccgggtgcctcatcggagctgagcatgtaaacaattcatacgaatgtgacattcccatcggcgcgggtatttgcgcaagttatcagacccagacgaactctcctaggcgggcccgcagcgtcgcttcccagtcaataatcgcctacaccatgagcctgggggcagaaaattctgtggcctactccaacaatagtattgctatcccaacaaacttcactatcagcgttaccacagaaattcttcccgtgtctatgactaagacctccgtcgattgtacgatgtatatatgcggcgactcaacagagtgtagtaatctgttgctccaatacggcagcttttgcacccagctgaacagagccttaactggaatcgcagtggagcaggataaaaatacacaggaagttttcgcgcaagtgaagcagatttataaaaccccgcctatcaaggactgtgggggatttaacttctcgcagattctgccagatccctccaaaccttctaagaggagctttatcgaggacctactcttcaataaggtaactctggctgatgccggttttataaaacaatacggcgactgccttggggatatcgcagcccgtgacttgatttgcgctcagaagttcaacggactgaccgtcctgcccccactcttaacagatgaaatgatcgcccagtatacgtcagcactgcttgctggcaccattacgagtggttggacattcggggccggcgcggccttgcagatcccttttgctatgcaaatggcataccggttcaatggaataggcgtgacccagaacgtgctctatgagaatcagaaactgattgccaaccagtttaactccgctatcgggaagattcaagactctctaagctccacagcctcagcactgggaaaactccaggacgtcgttaatcagaacgcgcaggccctgaatactcttgtgaagcaattgagcagtaacttcggcgctatctcttccgtactgaatgatatattaagccgactcgacaaggtggaagccgaggtccagatcgatagactgattaccggtaggcttcagtcgctgcaaacgtacgtgacacagcagttgatccgcgcagctgagattcgggcctcagcaaacctcgccgctaccaaaatgtctgaatgtgttctggggcagagtaagagagtggacttttgcggaaaaggctaccacctaatgtccttcccccaaagcgcgccacatggtgtcgtgtttctgcacgttacttatgtgccggcccaggagaagaatttcaccacagctcctgcaatctgtcacgatggcaaagcccattttcccagggaaggggtcttcgtatctaacggaactcactggtttgtgacccagcgcaatttctacgagccacagataattacaacggacaacacctttgttagcggcaattgcgatgtggtcatcgggatcgtgaacaatactgtatatgaccccctccaacctgagctggattccttcaaggaggaacttgacaaatacttcaagaaccatacatcaccagatgtggacttgggagatattagtggcatcaatgccagcgtcgttaacattcagaaggaaatagaccgactgaatgaggtggctaaaaacttaaacgaatctctcatcgacctgcaggagcttggtaagtatgagcagtacattaaatggccctggtatatctggctggggtttattgcaggactaatcgccatagtgatggtcaccatcatgctctgttgcatgacttcctgttgctcatgtctgaagggctgctgtagttgcggtagctgctgtaaattcgatgaagacgattccgagcctgtgttgaagggcgttaagctgcactacacatga

SEQ ID NO: 11981 - RNA, 3822 nt, synthetic construct
  misc_feature 1..3822: note = SARS-CoV-2/Tianmen/HBCDC-HB-07/2020__EPI_ISL_412983 spike protein CDS human (1-1273)
  source 1..3822: mol_type = other RNA
atgttcgtgtttctggtcctccttcccctggttagctcccagtgcgtgaacttgaccacaagaactcaattacctccagcctacactaattctttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgagttccgtgtgtacagctccgcgaataactgtacttttgaatatgtgtcacaacctttcctgatggacctggaaggcaagcagggtaattttaaaaacctcagagagttcgtctttaagaacattgatgggtacttcaaaatctacagtaagcacaccccaataaatttagttagggacctgccccagggatttagcgctcttgagcctttggtggatctgccaatcggcattaacatcacacggttccagactctactcgccctgcatcgctcttatcttaccccgggcgactcctcaagcgggtggacagcaggagccgctgcatactatgtaggttacctgcaacccagaacctttttgctcaaatataatgaaaacggcacgattactgatgccgtggactgcgctctggatcctttaagtgagacaaagtgtaccctgaagtctttcactgtcgaaaaagggatctaccagacatccaattttagggtgcagccaaccgagagcatagttcggttccccaacattacgaatctctgcccttttggagaggtgttcaacgccacccgcttcgcgtcggtctatgcatggaatcgaaagagaatctctaactgtgtggccgactactccgtactttacaattcagctagttttagcacattcaaatgctatggcgtttccccaactaagctgaacgacttgtgttttaccaatgtgtacgccgattctttcgtcattaggggtgacgaagtgcggcagatcgcacccgggcaaacaggaaaaatcgctgattataactacaagctaccggacgattttactggctgcgtcattgcctggaatagcaacaacctggactcaaaagtgggcgggaattataactacctctatcgtctgttccgcaagagtaatcttaagccttttgagagagatatatccaccgaaatctaccaggcgggaagcacaccctgtaacggtgttgagggcttcaattgctactttccactgcagtcttatgggttccaacctaccaacggagtgggctaccagccctatagggtagtcgtgttgtcatttgaactcctgcacgccccagcaactgtttgcggtcccaaaaagagtacgaatttagtgaaaaacaagtgtgtcaatttcaactttaatgggctgacaggcaccggagtgctaactgagagcaacaaaaagttcctccctttccagcagtttggccgggacattgctgataccacagacgccgtacgagatccacaaaccctggagatccttgacataactccgtgctccttcgggggagtgtctgttattacacccggtacgaatacctcgaaccaggtcgctgtgttgtaccaggacctgaattgtactgaagtgcctgtcgccatccacgcagatcagctcacaccaacctggcgcgtttatagcacaggctccaacgtgtttcaaactagagccgggtgcctgatcggagctgagcatgtgaacaattcatacgaatgtgacattcccatcggcgcgggtatttgcgcaagttatcagacccagacgaactctcctaggcgggcccgcagcgtagcttcccagtcaataatcgcctacaccatgagccttggggcagaaaattctgtcgcctactccaacaatagtattgctatcccaacaaacttcactatcagcgtgaccacagaaattctgcccgtttctatgactaagacctccgtggattgtacgatgtatatatgcggcgactcaacagagtgtagtaatttgctcctgcaatacggcagcttttgcacccagttaaacagagccctgactggaatcgcagtcgagcaggataaaaatacacaggaagtgttcgcgcaagttaagcagatttataaaaccccgcctatcaaggactttgggggattcaacttttcgcagattctaccagatccctccaaaccttctaagaggagcttcatcgaggacctcctgtttaataaggtgactcttgctgatgccggtttcataaaacaatacggcgactgtttgggggatatcgcagcccgtgacctgatttgcgctcagaagttcaacggactcaccgtactgcccccattactgacagatgaaatgatcgcccagtatacgtcagcacttttggctggcaccattacgagtggttggacatttggggccggcgcggccctccagatccctttcgctatgcaaatggcataccggtttaatggaataggcgtcacccagaacgtgctgtatgagaatcagaaactaattgccaaccagttcaactccgctatcgggaagattcaagactctctgagctccacagcctcagcactcggaaaactgcaggacgtggtcaatcagaacgcgcaggcccttaatactttggttaagcaactgagcagtaactttggcgctatctcttccgtgttaaatgatatactcagccgactggacaaggtagaagccgaggtgcagatcgatagacttattaccggtaggctgcagtcgttgcaaacgtacgtcacacagcagctcatccgcgcagctgagattcgggcctcagcaaacctggccgctaccaaaatgtctgaatgcgtgctagggcagagtaagagagttgacttctgtggaaaaggctaccacctgatgtcctttccccaaagcgcgccacatggtgtggtcttcctccacgtgacttatgttccggcccaggagaagaattttaccacagctcctgcaatctgccacgatggcaaagcccatttccccagggaaggggtgtttgtctctaacggaactcactggttcgtaacccagcgcaatttttacgagccacagataattacaacggacaacaccttcgtgagcggcaattgtgatgttgtgatcgggatcgtcaacaatactgtgtatgaccccctgcaacctgagcttgattccttcaaggaagagttggacaaatactttaagaaccatacatcaccagatgtagacctgggagatattagtggcatcaatgccagcgtggtcaacattcagaaggaaatagaccgattaaatgaggttgctaaaaacctcaacgaatctctgatcgaccttcaggagctgggtaagtatgagcagtacattaaatggccctggtatatctggctagggttcattgcaggactcatcgccatagtgatggtgaccatcatgctgtgctgtatgacttcctgctgttcatgcttgaagggctgttgcagttgtggtagctgctgcaaatttgatgaagacgattccgagcctgtcctgaagggcgtgaagttacactacacatga

SEQ ID NO: 11982 - RNA, 3822 nt, synthetic construct
  misc_feature 1..3822: note = SARS-CoV-2/Hong Kong/case42_VM20002493/2020__EPI_ISL_414527 spike protein CDS human (1-1273)
  source 1..3822: mol_type = other RNA
atgttcgtgtttctggtcctccttcccctggttagctcccagtgcgtgaacttgaccacaagaactcaattacctccagcctacacgaatagcttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgagttccgtgtgtacagctccgcgaataactgtacttttgaatatgtgtcacaacctttcctgatggacctggaaggcaagcagggtaattttaaaaacctcagagagttcgtctttaagaacattgatgggtacttcaaaatctacagtaagcacaccccaataaatttagttagggacctgccccagggatttagcgctcttgagcctttggtggatctgccaatcggcattaacatcacacggttccagactctactcgccctgcatcgctcttatcttaccccgggcgactcctcaagcgggtggacagcaggagccgctgcatactatgtaggttacctgcaacccagaacctttttgctcaaatataatgaaaacggcacgattactgatgccgtggactgcgctctggatcctttaagtgagacaaagtgtaccctgaagtctttcactgtcgaaaaagggatctaccagacatccaattttagggtgcagccaaccgagagcatagttcggttccccaacattacgaatctctgcccttttggagaggtgttcaacgccacccgcttcgcgtcggtctatgcatggaatcgaaagagaatctctaactgtgtggccgactactccgtactttacaattcagctagttttagcacattcaaatgctatggcgtttccccaactaagctgaacgacttgtgttttaccaatgtgtacgccgattctttcgtcattaggggtgacgaagtgcggcagatcgcacccgggcaaacaggaaaaatcgctgattataactacaagctaccggacgattttactggctgcgtcattgcctggaatagcaacaacctggactcaaaagtgggcgggaattataactacctctatcgtctgttccgcaagagtaatcttaagccttttgagagagatatatccaccgaaatctaccaggcgggaagcacaccctgtaacggtgttgagggcttcaattgctactttccactgcagtcttatgggttccaacctaccaacggagtgggctaccagccctatagggtagtcgtgttgtcatttgaactcctgcacgccccagcaactgtttgcggtcccaaaaagagtacgaatttagtgaaaaacaagtgtgtcaatttcaactttaatgggctgacaggcaccggagtgctaactgagagcaacaaaaagttcctccctttccagcagtttggccgggacattgctgataccacagacgccgtacgagatccacaaaccctggagatccttgacataactccgtgctccttcgggggagtgtctgttattacacccggtacgaatacctcgaaccaggtcgctgtgttgtaccaggacgtgaattgtactgaagtccctgttgccatccacgcagatcagctgacaccaacctggcgcgtgtatagcacaggctccaacgtgtttcaaactagagccgggtgcctcatcggagctgagcatgtaaacaattcatacgaatgtgacattcccatcggcgcgggtatttgcgcaagttatcagacccagacgaactctcctaggcgggcccgcagcgtcgcttcccagtcaataatcgcctacaccatgagcctgggggcagaaaattctgtggcctactccaacaatagtattgctatcccaacaaacttcgccatcagcgttactaccgaaattcttcccgtgtctatgacaaagacttccgtcgattgtaccatgtatatatgcggcgactcaacggagtgtagtaatctgttgctccaatacggatctttttgcacacagctgaacagagcattaaccggcatcgcggtggagcaggataaaaatactcaggaagttttcgctcaagtgaagcagatttataaaacaccgcctatcaaggactttgggggattcaacttttcgcagattctgccagatccctccaaaccttctaagaggagcttcatcgaggacctactctttaataaggtaaccctggccgatgcaggtttcataaaacaatacggcgactgtcttggggatatcgccgctcgtgacttgatttgcgcccagaagttcaacggactgactgtcctgcccccactcttaaccgatgaaatgatcgcacagtatacatcagctctgcttgccggcacgattaccagtggttggacttttggggcgggcgccgctttgcagatccctttcgcaatgcaaatggcctaccggtttaatggaataggcgtgacacagaacgtgctctatgagaatcagaaactgattgctaaccagttcaactccgccatcgggaagattcaagactctctaagctccaccgcatcagcgctgggaaaactccaggacgtcgttaatcagaacgcccaggctctgaatacacttgtgaagcaattgagcagtaactttggcgccatctcttccgtactgaatgatatattaagccgactcgacaaggtggaagcagaggtccagatcgatagactgattactggtaggcttcagtcgctgcaaacctacgtgacgcagcagttgatccgcgctgccgagattcgggcatcagccaacctcgctgcgacaaaaatgtctgaatgcgttctggggcagagtaagagagtggacttctgtggaaaaggctaccacctaatgtcctttccccaaagcgccccacatggtgtcgtgttcctgcacgttacctatgtgccggcacaggagaagaattttactaccgctcctgccatctgccacgatggcaaagcccatttccccagggaaggggtctttgtatctaacggaacacactggttcgtgactcagcgcaatttttacgagccacagataattaccacagacaacacgttcgttagcggcaattgtgatgtggtcatcgggatcgtgaacaataccgtatatgaccccctccaacctgagctggattccttcaaggaggaacttgacaaatactttaagaaccatacttcaccagatgtggacttgggagatattagtggcatcaatgctagcgtcgttaacattcagaaggaaatagaccgactgaatgaggtggccaaaaacttaaacgaatctctcatcgacctgcaggagcttggtaagtatgagcagtacattaaatggccctggtatatctggctggggttcattgcaggactaatcgcgatagtgatggtcacaatcatgctctgctgtatgacctcctgctgttcatgcctgaagggctgttgcagttgtggtagctgctgcaaatttgatgaagacgattccgagcctgtgttgaagggcgttaagctgcactacacttga

SEQ ID NO: 11983 - RNA, 3822 nt, synthetic construct
  misc_feature 1..3822: note = SARS-CoV-2/USA/CruiseA-23/2020__EPI_ISL_414482 spike protein CDS human (1-1273)
  source 1..3822: mol_type = other RNA
atgttcgtgtttctggtcctccttcccctggttagctcccagtgcgtgaacttgaccacaagaactcaattacctccagcctacactaattctttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgagttccgtgtgtacagctccgcgaataactgtacttttgagtatgtgtcacaacctttcctgatggacctggaagtcaagcagggcaattttaaaaacctcagagagttcgtttttaagaacattgatggttacttcaaaatctacagtaagcacaccccaataaatttagtgagggacctgccccaggggtttagcgctcttgagcctttggtagatctgccaatcggaattaacatcacacggttccagactctactcgccctgcatcgctcttatcttaccccgggcgactcctcaagcggctggacagcaggggccgctgcatactatgtgggatacctgcaacccagaacctttttgctcaaatataatgaaaacggtacgattactgatgccgtcgactgcgctctggatcctttaagtgagacaaagtgtaccctgaagtctttcactgtggaaaaaggcatctaccagacatccaattttagggttcagccaaccgagagcatagtgcggttccccaacattacgaatctctgcccttttggggaggtcttcaacgccacccgcttcgcgtcggtgtatgcatggaatcgaaagagaatctctaactgtgtagccgactactccgttctttacaattcagctagttttagcacattcaaatgctatggagtgtccccaactaagctgaacgacttgtgttttaccaatgtctacgccgattctttcgtgattaggggcgacgaagtccggcagatcgcacccggtcaaacagggaaaatcgctgattataactacaagctaccggacgattttactggatgcgtgattgcctggaatagcaacaacctggactcaaaagttggcggcaattataactacctctatcgtctgttccgcaagagtaatcttaagccttttgagagagatatatccaccgaaatctaccaggcggggagcacaccctgtaacggagtggagggtttcaattgctactttccactgcagtcttatggcttccaacctaccaacggggtaggataccagccctatagggtcgtggttttgtcatttgaactcctgcacgccccagcaactgtgtgcggccccaaaaagagtacgaatttagtcaaaaacaagtgtgtgaatttcaactttaatggtctgacagggaccggcgtactaactgagagcaacaaaaagttcctccctttccagcagtttggacgggacattgctgataccacagacgccgtgcgagatccacaaaccctggagatccttgacataactccgtgctccttcggcggggtttctgtcattacacccggaacgaatacctcgaaccaggtggctgtgttgtaccaggacgtcaattgtactgaagttcctgtggccatccacgcagatcagctgacaccaacctggcgcgtgtatagcacaggttccaacgtatttcaaactagagccggctgcctcatcggggctgagcatgtcaacaattcatacgaatgtgacattcccatcggagcgggcatttgcgcaagttatcagacccagacgaactctcctaggcgggcccgcagcgtggcttcccagtcaataatcgcctacaccatgagcctgggtgcagaaaattctgttgcctactccaacaatagtattgctatcccaacaaacttcactatcagcgtgaccacagaaattcttcccgtctctatgactaagacctccgtggattgtacgatgtatatatgcggggactcaacagagtgtagtaatctgttgctccaatacggcagcttttgcacccagctgaacagagccttaactggaatcgcagttgagcaggataaaaatacacaggaagtgttcgcgcaagtaaagcagatttataaaaccccgcctatcaaggactttggcgggttcaacttttcgcagattctgccagatccctccaaaccttctaagaggagcttcatcgaggacctactctttaataaggtcactctggctgatgccggattcataaaacaatacggtgactgtcttggcgatatcgcagcccgtgacttgatttgcgctcagaagttcaacgggctgaccgtgctgcccccactcttaacagatgaaatgatcgcccagtatacgtcagcactgcttgctggaaccattacgagtggctggacatttggtgccggggcggccttgcagatccctttcgctatgcaaatggcataccggtttaatggcataggagtgacccagaacgtcctctatgagaatcagaaactgattgccaaccagttcaactccgctatcggcaagattcaagactctctaagctccacagcctcagcactggggaaactccaggacgttgtgaatcagaacgcgcaggccctgaatactcttgtaaagcaattgagcagtaactttggagctatctcttccgtgctgaatgatatattaagccgactcgacaaggtcgaagccgaggtgcagatcgatagactgattaccggcaggcttcagtcgctgcaaacgtacgttacacagcagttgatccgcgcagctgagattcgggcctcagcaaacctcgccgctaccaaaatgtctgaatgcgtgctgggtcagagtaagagagtcgacttctgtgggaaaggataccacctaatgtcctttccccaaagcgcgccacatggcgtggttttcctgcacgtgacttatgtcccggcccaggagaagaattttaccacagctcctgcaatctgccacgatggtaaagcccatttccccagggaaggcgtatttgtgtctaacgggactcactggttcgttacccagcgcaatttttacgagccacagataattacaacggacaacaccttcgtgagcggaaattgtgatgtcgtgatcggcatcgtaaacaatactgtgtatgaccccctccaacctgagctggattccttcaaggaagaacttgacaaatactttaagaaccatacatcaccagatgtcgacttgggggatattagtggaatcaatgccagcgttgtgaacattcagaaggaaatagaccgactgaatgaggtggctaaaaacttaaacgaatctctcatcgacctgcaggagcttggcaagtatgagcagtacattaaatggccctggtatatctggctgggtttcattgcagggctaatcgccatagtcatggtgaccatcatgctctgctgtatgacttcctgctgttcatgcctgaagggatgttgcagttgtggcagctgctgcaaatttgatgaagacgattccgagcctgttttgaagggtgtaaagctgcactacacatga

SEQ ID NO: 11984 - RNA, 3822 nt, synthetic construct
  misc_feature 1..3822: note = SARS-CoV-2/Hong Kong/case85_VM20002868/2020__EPI_ISL_414519 spike protein CDS human (1-1273)
  source 1..3822: mol_type = other RNA
atgttcgtgtttctggtcctcgttccccttgtgagctcccagtgcgtaaacctgaccacaagaactcaattgcctccagcctacactaattctttcaccaggggcgtgtattacccggacaaggtctttcggtcaagtgtgttacacagcacacaggatctgttcctaccctttttctccaacgttacttggtttcatgctatccacgtgtctgggaccaatggaacaaaacgcttcgacaaccctgtcctcccatttaatgatggtgtgtatttcgcatcgaccgagaagtcaaacattatacgaggctggatctttgggactacactggacagcaaaacccagagtcttctgattgtaaataacgccacgaatgttgtgatcaaggtctgtgagttccagttttgcaacgatcccttcttgggagtgtactatcataaaaataacaagtcctggatggagtctgagttccgtgtgtacagctccgcgaataactgtacttttgaatatgtctcacaacctttcctcatggacctggaaggcaagcagggtaattttaaaaacctgagagagttcgtttttaagaacattgatgggtacttcaaaatctacagtaagcacaccccaataaatctcgtgagggacttaccccagggatttagcgctctggagcctcttgtagatttgccaatcggcattaacatcacacggttccagactctgctagccctccatcgctcttatctgaccccgggcgactcctcaagcgggtggacagcaggagccgctgcatactatgtgggttaccttcaacccagaacctttctgttgaaatataatgaaaacggcacgattactgatgccgtcgactgcgctctcgatcctctgagtgagacaaagtgtaccttaaagtctttcactgtggaaaaagggatctaccagacatccaattttagggttcagccaaccgagagcatagtgcggttccccaacattacgaatctgtgcccttttggagaggtcttcaacgccacccgcttcgcgtcggtgtatgcatggaatcgaaagagaatctctaactgtgtagccgactactccgttctctacaattcagctagttttagcacattcaaatgctatggcgtgtccccaactaaacttaacgacctgtgttttaccaatgtctacgccgattctttcgtgattaggggtgacgaagtccggcagatcgcacccgggcaaacaggaaagatcgctgattataactacaagttgccggacgattttactggctgcgtgattgcctggaatagcaacaacctagactcaaaagttggcgggaattataactacctgtatcgtctcttccgcaagagtaatctgaagccttttgagagagatatatccaccgaaatctaccaggcgggaagcacaccctgtaacggtgtggagggcttcaattgctactttccacttcagtcttatgggttccaacctaccaacggagtaggctaccagccctatagggtcgtggttctgtcatttgaattgctccacgccccagcaactgtgtgcggtcccaaaaagagtacgaatctggtcaaaaacaagtgtgtgaatttcaactttaatgggttaacaggcaccggagtactgactgagagcaacaaaaagttcctacctttccagcagtttggccgggacattgctgataccacagacgccgtgcgagatccacaaaccctcgagatcctggacataactccgtgctccttcgggggagtttctgtcattacacccggtacgaatacctcgaaccaggtggctgtgctttaccaggacgtcaattgtactgaagttcctgtggccatccacgcagatcagttgacaccaacctggcgcgtgtatagcacaggctccaacgtatttcaaactagagccgggtgcctgatcggagctgagcatgtcaacaattcatacgaatgtgacattcccatcggcgcgggtatttgcgcaagttatcagacccagacgaactctcctaggcgggcccgcagcgtggcttcccagtcaataatcgcctacaccatgagcctcggggcagaaaattctgttgcctactccaacaatagtattgctatcccaacaaacttcactatcagcgtgaccacagaaattctgcccgtctctatgactaagacctccgtggattgtacgatgtatatatgcggcgactcaacagagtgtagtaatcttctgttgcaatacggcagcttttgcacccagctcaacagagccctgactggaatcgcagttgagcaggataaaaatacacaggaagtgttcgcgcaagtaaagcagatttataaaaccccgcctatcaaggactttgggggattcaacttttcgcagattttaccagatccctccaaaccttctaagaggagcttcatcgaggacctgctatttaataaggtcactctcgctgatgccggtttcataaaacaatacggcgactgtctgggggatatcgcagcccgtgaccttatttgcgctcagaagttcaacggattgaccgtgctgcccccactcctgacagatgaaatgatcgcccagtatacgtcagcattactggctggcaccattacgagtggttggacatttggggccggcgcggcccttcagatccctttcgctatgcaaatggcataccggtttaatggaataggcgtgacccagaacgtcttgtatgagaatcagaaactcattgccaaccagttcaactccgctatcgggaagattcaagactctctgagctccacagcctcagcactaggaaaactgcaggacgttgtgaatcagaacgcgcaggccctcaatactctggtaaagcaacttagcagtaactttggcgctatctcttccgtgttgaatgatatactgagccgattagacaaggtcgaagccgaggtgcagatcgatagactcattaccggtaggctgcagtcgcttcaaacgtacgttacacagcagctgatccgcgcagctgagattcgggcctcagcaaacttggccgctaccaaaatgtctgaatgcgtgctcgggcagagtaagagagtcgacttctgtggaaaaggctaccacctgatgtcctttccccaaagcgcgccacatggtgtggttttcctacacgtgacttatgtcccggcccaggagaagaattttaccacagctcctgcaatctgccacgatggcaaagcccatttccccagggaaggggtatttgtgtctaacggaactcactggttcgttacccagcgcaatttttacgagccacagataattacaacggacaacaccttcgtgagcggcaattgtgatgtcgtgatcgggatcgtaaacaatactgtgtatgaccccctgcaacctgagctcgattccttcaaggaggaactggacaaatactttaagaaccatacatcaccagatgtcgaccttggagatattagtggcatcaatgccagcgttgtgaacattcagaaggaaatagaccgattgaatgaggtggctaaaaacctgaacgaatctttaatcgacctccaggagctgggtaagtatgagcagtacattaaatggccctggtatatctggcttgggttcattgcaggactgatcgccatagtcatggtgaccatcatgctatgctgtatgacttcctgctgttcatgcctcaagggctgttgcagttgtggtagctgctgcaaatttgatgaagacgattccgagcctgttctgaagggcgtaaagttgcactacacatga

SEQ ID NO: 11985 - RNA, 3822 nt, synthetic construct
  misc_feature 1..3822: note = SARS-CoV-2/England/200990660/2020__EPI_ISL_414523 spike protein CDS human (1-1273)
  source 1..3822: mol_type = other RNA
atgttcgtgtttctggtcctccttcccctggttagctcccagtgcgtgaacttgaccacaagaactcaattacctccagcctacactaattctttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgagttccgtgtgtacagctccgcgaataactgtacttttgagtatgtgtcacaacctttcctgatggacctggaaggcaagcagggtaattttaaaaacctcagagagttcgtctttaagaacattgatgggtacttcaaaatctacagtaagcacaccccaataaatttagttagggacctgccccagggatttagcgctcttgagcctttggtggatctgccaatcggcattaacatcacacggttccagactctactcgccctgcatcgctcttatcttaccccgggcgactcctcaagcgggtggacagcaggagccgctgcatactatgtaggttacctgcaacccagaacctttttgctcaaatataatgaaaacggcacgattactgatgccgtggactgcgctctggatcctttaagtgagacaaagtgtaccctgaagtctttcactgtcgaaaaagggatctaccagacatccaattttagggtgcagccaaccgagagcatagttcggttccccaacattacgaatctctgcccttttggagaggtgttcaacgccacccgcttcgcgtcggtctatgcatggaatcgaaagagaatctctaactgtgtggccgactactccgtactttacaattcagctagttttagcacattcaaatgctatggcgtttccccaactaagctgaacgacttgtgttttaccaatgtgtacgccgattctttcgtcattaggggtgacgaagtgcggcagatcgcacccgggcaaacaggaaaaatcgctgattataactacaagctaccggacgattttactggctgcgtcattgcctggaatagcaacaacctggactcaaaagtgggcgggaattataactacctctatcgtctgttccgcaagagtaatcttaagccttttgagagagatatatccaccgaaatctaccaggcgggaagcacaccctgtaacggtgttgagggcttcaattgctactttccactgcagtcttatgggttccaacctaccaacggagtgggctaccagccctatagggtagtcgtgttgtcatttgaactcctgcacgccccagcaactgtttgcggtcccaaaaagagtacgaatttagtgaaaaacaagtgtgtcaatttcaactttaatgggctgacaggcaccggagtgctaactgagagcaacaaaaagttcctccctttccagcagtttggccgggacattgctgataccacagacgccgtacgagatccacaaaccctggagatccttgacataactccgtgctccttcgggggagtgtctgttattacacccggtacgaatacctcgaaccaggtcgctgtgttgtaccagggcgtgaattgtactgaagtccctgttgccatccacgcagaccagctgacaccaacctggcgcgtgtatagcacagggtccaacgtgtttcaaactagagccggatgcctcatcggcgctgagcatgtaaacaattcatacgaatgtgatattcccatcggtgcggggatttgcgcaagttatcagacccagacgaactctcctaggcgggcccgcagcgtcgcttcccagtcaataatcgcctacaccatgagcctgggcgcagaaaattctgtggcctactccaacaatagtattgctatcccaacaaacttcactatcagcgttaccacagaaattcttcccgtgtctatgactaagacctccgtcgactgtacgatgtatatatgcggagattcaacagagtgtagtaatctgttgctccaatacggcagcttttgcacccagctgaacagagccttaactgggatcgcagtggagcaggacaaaaatacacaggaagttttcgcgcaagtgaagcagatttataaaaccccgcctatcaaggattttggaggtttcaacttttcgcagattctgccagacccctccaaaccttctaagaggagcttcatcgaggatctactctttaataaggtaactctggctgacgccggcttcataaaacaatacggggattgtcttggagacatcgcagcccgtgatttgatttgcgctcagaagttcaacggcctgaccgtcctgcccccactcttaacagacgaaatgatcgcccagtatacgtcagcactgcttgctggtaccattacgagtgggtggacatttggcgccggagcggccttgcagatccctttcgctatgcaaatggcataccggtttaatggcataggggtgacccagaacgtgctctatgagaatcagaaactgattgccaaccagttcaactccgctatcggaaagattcaagattctctaagctccacagcctcagcactgggcaaactccaggacgtcgttaatcagaacgcgcaggccctgaatactcttgtgaagcaattgagcagtaactttggtgctatctcttccgtactgaatgacatattaagccgactcgataaggtggaagccgaggtccagatcgacagactgattaccgggaggcttcagtcgctgcaaacgtacgtgacacagcagttgatccgcgcagctgagattcgggcctcagcaaacctcgccgctaccaaaatgtctgaatgcgttctgggacagagtaagagagtggatttctgtggcaaaggttaccacctaatgtcctttccccaaagcgcgccacatggcgtcgtgttcctgcacgttacttatgtgccggcccaggagaagaattttaccacagctcctgcaatctgccacgacgggaaagcccatttccccagggaaggagtctttgtatctaacggcactcactggttcgtgacccagcgcaatttttacgagccacagataattacaacggataacaccttcgttagcgggaattgtgacgtggtcatcggaatcgtgaacaatactgtatatgatcccctccaacctgagctggactccttcaaggaagaacttgataaatactttaagaaccatacatcaccagacgtggatttgggcgacattagtggtatcaatgccagcgtcgttaacattcagaaggaaatagatcgactgaatgaggtggctaaaaacttaaacgaatctctcatcgacctgcaggagcttgggaagtatgagcagtacattaaatggccctggtatatctggctgggattcattgcaggcctaatcgccatagtgatggtcaccatcatgctctgctgtatgacttcctgctgttcatgcctgaagggttgttgcagttgtggcagctgctgcaaatttgacgaagatgactccgagttggtgctgaagggggttaagttacactacacatga

SEQ ID NO: 11986 - RNA, 3822 nt, synthetic construct
  misc_feature 1..3822: note = SARS-CoV-2/Australia/NSW09/2020__EPI_ISL_413595 spike protein CDS human (1-1273)
  source 1..3822: mol_type = other RNA
atgttcgtgtttctggtcctccttcccctggttagctcccagtgcgtgaacttgaccacaagaactcaattacctccagcctacactaattctttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgagttccgtgtgtacagctccgcgaataactgtacttttgaatatgtgtcacaacctttcctgatggacctggaaggcaagcagggtaattttaaaaacctcagagagttcgtctttaagaacattgatgggtacttcaaaatctacagtaagcacaccccaataaatttagttagggacctgccccagggatttagcgctcttgagcctttggtggatctgccaatcggcattaacatcacacggttccagactctactcgccctgcatcgctcttatcttaccccgggcgactcctcaagcgggtggacagcaggagccgctgcatactatgtaggttacctgcaacccagaacctttttgctcaaatataatgaaaacggcacgattactgatgccgtggactgcgctctggatcctttaagtgagacaaagtgtaccctgaagtctttcactgtcgaaaaagggatctaccagacatccaattttagggtgcagccaaccgagagcatagttcggttccccaacattacgaatctctgcccttttggagaggtgttcaacgccacccgcttcgcgtcggtctatgcatggaatcgaaagagaatctctaactgtgtggccgactactccgtactttacaattcagctagttttagcacattcaaatgctatggcgtttccccaactaagctgaacgacttgtgttttaccaatgtgtacgccgattctttcgtcattaggggtgacgaagtgcggcagatcgcacccgggcaaacaggaaaaatcgctgattataactacaagctaccggacgattttactggctgcgtcattgcctggaatagcaacaacctggactcaaaagtgggcgggaattataactacctctatcgtctgttccgcaagagtaatcttaagccttttgagagagatatatccaccgaaatctaccaggcgggaagcacaccctgtaacggtgttgagggcttcaattgctactttccactgcagtcttatgggttccaacctaccaacggagtgggctaccagccctatagggtagtcgtgttgtcatttgaactcctgcacgccccagcaactgtttgcggtcccaaaaagagtacgaatttagtgaaaaacaagtgtgtcaatttcaactttaatgggctgacaggcaccggagtgctaactgagagcaacaaaaagttcctccctttccagcagtttggccgggacattgctgataccacagacgccgtacgagatccacaaaccctggagatccttgacataactccgtgctccttcgggggagtgtctgttattacacccggtacgaatacctcgaaccaggtcgctgtgttgtaccaggacgtgaattgtactgaagtccctgttgccatccacgcagatcagctgacaccaacctggcgcgtgtatagcacaggctccaacgtgtttcaaactagagccgggtgcctcatcggagctgagcatgtaaacaattcatacgaatgtgacattcccatcggcgcgggtatttgcgcaagttatcagacccagacgaactctcctaggcgggcccgcagcgtcgcttcccagtcaataatcgcctacaccatgagcctgggggcagaaaattctgtggcctactccaacaatagtattgctatcccaacaaacttcactatcagcgttaccacagaaattcttcccgtgtctatgactaagacctccgtcgattgtacgatgtatatatgcggcgactcaacagagtgtagtaatctgttgctccaatacggcagcttttgcacccagctgaacagagccttaactggaatcgcagtggagcaggataaaaatacacaggaagttttcgcgcaagtgaagcagatttataaaaccccgcctatcaaggactttgggggattcaacttttcgcagattctgccagatccctccaaaccttctaagaggagcttcatcgaggacctactctttaataaggtaactctggctgatgccggtttcataaaacaatacggcgactgtcttggggatatcgcagcccgtgacttgatttgcgctcagaagttcaacggactgaccgtcctacccccactgttaacagatgaaatgatcgcccagtatacgtcagcactgcttgctggcaccattacgagtggttggacatttggggccggcgcggccttgcagatccctttcgctatgcaaatggcataccggtttaatggaataggcgtgacccagaacgtgctctatgagaatcagaaactgattgccaaccagttcaactccgctatcgggaagattcaagactctctcagctttacagcctccgcactgggaaaactccaggacgtcgttaatcagaacgcgcaggccctgaatactcttgtgaagcaattgtcaagcaacttcggcgctatcagttctgtactgaatgatatattatcccgactcgacaaggtggaagccgaggtccagatcgatagactgattaccggtaggcttcagagcctgcaaacgtacgtgacacagcagttgatccgcgcagctgagattcgggcctcggcaaacctcgccgctaccaaaatgtcagaatgcgttctggggcagtctaagagagtggacttttgtggaaaaggctaccacctaatgagtttcccccaatccgcgccacatggtgtcgtgtttctgcacgttacttatgtgccggcccaggagaagaatttcaccacagctcctgcaatctgccacgatggcaaagcccattttcccagggaaggggtcttcgtaagcaacggaactcactggtttgtgacccagcgcaatttctacgagccacagataattacaacggacaacaccttcgtttctggcaattgtgatgtggtcatcgggatcgtgaacaatactgtatatgaccccctccaacctgagctggatagctttaaggaggaacttgacaaatacttcaagaaccatacatccccagatgtggacttgggagatatttcaggcatcaatgccagtgtcgttaacattcagaaggaaatagaccgactgaatgaggtggctaaaaacttaaacgaaagcctcatcgacctgcaggagcttggtaagtatgagcagtacattaaatggccctggtatatctggctggggtttattgcaggactaatcgccatagtgatggtcaccatcatgctctgctgtatgacttcttgctgttcctgcctgaagggctgttgctcatgtggtagttgctgcaaattcgatgaagacgatagcgagcctgtgttgaagggcgttaagctgcactacacatga

SEQ ID NO: 11987 - RNA, 3822 nt, synthetic construct
  misc_feature 1..3822: note = SARS-CoV-2/Australia/NSW10/2020__EPI_ISL_413596 spike protein CDS human (1-1273)
  source 1..3822: mol_type = other RNA
atgttcgtgtttctggtcctccttcccctggttagctcccagtgcgtgaacttgaccacaagaactcaattacctccagcctacactaattctttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgagttccgtgtgtacagctccgcgaataactgtacttttgaatatgtgtcacaacctttcctgatggacctggaaggcaagcagggtaattttaaaaacctcagagagttcgtctttaagaacattgatgggtacttcaaaatctacagtaagcacaccccaataaatttagttagggacctgccccagggatttagcgctcttgagcctttggtggatctgccaatcggcattaacatcacacggttccagactctactcgccctgcatcgctcttatcttaccccgggcgactcctcaagcgggtggacagcaggagccgctgcatactatgtaggttacctgcaacccagaacctttttgctcaaatataatgaaaacggcacgattactgatgccgtggactgcgctctggatcctttaagtgagacaaagtgtaccctgaagtctttcactgtcgaaaaagggatctaccagacatccaattttagggtgcagccaaccgagagcatagttcggttccccaacattacgaatctctgcccttttggagaggtgttcaacgccacccgcttcgcgtcggtctatgcatggaatcgaaagagaatctctaactgtgtggccgactactccgtactttacaattcagctagttttagcacattcaaatgctatggcgtttccccaactaagctgaacgacttgtgttttaccaatgtgtacgccgattctttcgtcattaggggtgacgaagtgcggcagatcgcacccgggcaaacaggaaaaatcgctgattataactacaagctaccggacgattttactggctgcgtcattgcctggaatagcaacaacctggactcaaaagtgggcgggaattataactacctctatcgtctgttccgcaagagtaatcttaagccttttgagagagatatatccaccgaaatctaccaggcgggaagcacaccctgtaacggtgttgagggcttcaattgctactttccactgcagtcttatgggttccaacctaccaacggagtgggctaccagccctatagggtagtcgtgttgtcatttgaactcctgcacgccccagcaactgtttgcggtcccaaaaagagtacgaatttagtgaaaaacaagtgtgtcaatttcaactttaatgggctgacaggcaccggagtgctaactgagagcaacaaaaagttcctccctttccagcagtttggccgggacattgctgataccacagacgccgtacgagatccacaaaccctggagatccttgacataactccgtgctccttcgggggagtgtctgttattacacccggtacgaatacctcgaaccaggtcgctgtgttgtaccaggacgtgaattgtactgaagtccctgttgccatccacgcagatcagctgacaccaacctggcgcgtgtatagcacaggctccaacgtgtttcaaactagagccgggtgcctcatcggagctgagcatgtaaacaattcatacgaatgtgacattcccatcggcgcgggtatttgcgcaagttatcagacccagacgaactctcctaggcgggcccgcagcgtcgcttcccagtcaataatcgcctacaccatgagcctgggggcagaaaattctgtggcctactccaacaatagtattgctatcccaacaaacttcactatcagcgttaccacagaaattcttcccgtgtctatgactaagacctccgtcgattgtacgatgtatatatgcggcgactcaacagagtgtagtaatctgttgctccaatacggcagcttttgcacccagctgaacagagccttaactggaatcgcagtggagcaggataaaaatacacaggaagttttcgcgcaagtgaagcagatttataaaaccccgcctatcaaggactttgggggattcaacttttcgcagattctgccagatccctccaaaccttctaagaggagcttcatcgaggacctactctttaataaggtaactctggctgatgccggtttcataaaacaatacggcgactgtcttggggatatcgcagcccgtgacttgatttgcgctcagaagttcaacggactgaccgtcctgcccccactcttaacagatgaaatgatcgcccagtatacgtcagcactgcttgctggcaccattacgagtggttggacatttggggccggcgcggccttgcagatccctttcgctatgcaaatggcataccggtttaatggaataggcgtgacccagaacgtgctctatgagaatcagaaactgattgccaaccagttcaactccgctatcgggaagattcaagactctctaagctccacagcctcagcactgggaaaactccaggacgtcgttaatcagaacgcgcaggccctgaatactcttgtgaagcaattgagcagtaactttggcgctatctcttccgtactgaatgatatattaagccgactcgacaaggtggaagccgaggtccagatcgatagactgattaccggtaggcttcagtcgctgcaaacgtacgtgacacagcagttgatccgcgcagctgagattcgggcctcagcaaacctcgccgctaccaaaatgtctgaatgcgttctggggcagagtaagagagtggacttctgtggaaaaggctaccacctaatgtcctttccccaaagcgcgccacatggtgtcgtgttcctgcacgttacttatgtgccggcccaggagaagaattttaccacagctcctgcaatctgccacgatggcaaagcccatttccccagggaaggggtctttgtatctaacggaactcactggttcgtgacccagcgcaatttttacgagccacagataattacaacggacaacaccttcgttagcggcaattgtgatgtggtcatcgggatcgtgaacaatactgtatatgaccccctccaacctgagctggattccttcaaggaggaacttgacaaatactttaagaaccatacatcaccagatgtggacttgggagatattagtggcatcaatgccagcgtcgttaacattcagaaggaaatagaccgactgaatgaggtggctaaaaacttaaacgaatctctcatcgacctgcaggagcttggtaagtatgagcagtacattaaatggccctggtatatctggctggggttcattgcaggactaatcgccatagtgatggtcaccatcatgctctgctgtatgacttcctgctgttcatgcctgaagggctgttgcagttgtggtagctgctttaaattcgatgaagacgattccgagcctgtgttgaagggcgttaagctgcactacacatga

SEQ ID NO: 11988 - RNA, 3822 nt, synthetic construct
  misc_feature 1..3822: note SARS-CoV-2/Switzerland/1000477797/2020__EPI_ISL_413023 spike protein CDS human (1-1273)
  source 1..3822: mol_type = other RNA
atgttcgtgtttctggtcctccttcccctggttagctcccagtgcgtgaacttgaccacaagaactcaattacctccagcctacactaattctttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgagttccgtgtgtacagctccgcgaataactgtacttttgaatatgtgtcacaacctttcctgatggacctggaaggcaagcagggtaattttaaaaacctcagagagttcgtctttaagaacattgatgggtacttcaatatctacagtaaacacaccccaataaacttagttagggacctgccccagggatttagcgctcttgagcctttggtggatctgccaatcggcattaatatcacacggttccagactctactcgccctgcatcgctcttatcttaccccgggcgactcctcaagcgggtggacagcaggagccgctgcatactatgtaggttacctgcaacccagaacctttttgctcaagtataacgaaaatggcacgattactgatgccgtggactgcgctctggatcctttaagtgagacaaaatgtaccctgaagtctttcactgtcgaaaaggggatctaccagacatccaactttagggtgcagccaaccgagagcatagttcggttccccaatattacgaacctctgcccttttggagaggtgttcaatgccacccgcttcgcgtcggtctatgcatggaaccgaaaaagaatctctaattgtgtggccgactactccgtactttacaactcagctagttttagcacattcaagtgctatggcgtttccccaactaaactgaatgacttgtgttttaccaacgtgtacgccgattctttcgtcattaggggtgacgaagtgcggcagatcgcacccgggcaaacaggaaagatcgctgattataattacaaactaccggacgattttactggctgcgtcattgcctggaacagcaacaatctggactcaaaggtgggcgggaactataattacctctatcgtctgttccgcaaaagtaaccttaagccttttgagagagatatatccaccgaaatctaccaggcgggaagcacaccctgtaatggtgttgagggcttcaactgctactttccactgcagtcttatgggttccaacctaccaatggagtgggctaccagccctatagggtagtcgtgttgtcatttgaactcctgcacgccccagcaactgtttgcggtcccaagaaaagtacgaacttagtgaagaataaatgtgtcaacttcaattttaacgggctgacaggcaccggagtgctaactgagagcaataagaaattcctccctttccagcagtttggccgggacattgctgataccacagacgccgtacgagatccacaaaccctggagatccttgacataactccgtgctccttcgggggagtgtctgttattacacccggtacgaacacctcgaatcaggtcgctgtgttgtaccagggcgtgaactgtactgaagtccctgttgccatccacgcagaccagctgacaccaacctggcgcgtgtatagcacagggtccaacgtgtttcaaactagagccggatgcctcatcggcgctgagcatgtaaataactcatacgaatgtgatattcccatcggtgcggggatttgcgcaagttatcagacccagaccaattctcctaggcgggcccgcagcgtcgcttcccagtcaataatcgcctacacgatgagcctgggcgcagagaactctgtggcctactccaataacagtattgctatcccaacaaatttcactatcagcgttaccacagaaattcttcccgtgtctatgactaagacctccgtcgactgtacgatgtatatatgcggagattcaacagagtgtagtaacctgttgctccaatacggcagcttttgcacccagctgaatagagccttaactgggatcgcagtggagcaggacaagaacacacaggaagttttcgcgcaagtgaaacagatttataagaccccgcctatcaaagattttggaggtttcaatttttcgcagattctgccagacccctccaagccttctaaaaggagcttcatcgaggatctactctttaacaaggtaactctggctgacgccggcttcataaagcaatacggggattgtcttggagacatcgcagcccgtgatttgatttgcgctcagaaattcaatggcctgaccgtcctgcccccactcttaacagacgaaatgatcgcccagtatacgtcagcactgcttgctggtaccattacgagtgggtggacatttggcgccggagcggccttgcagatccctttcgctatgcaaatggcataccggtttaacggcataggggtgacccagaatgtgctctatgagaaccagaagctgattgccaaccagttcaattccgctatcggaaaaattcaagattctctaagctccacagcctcagcactgggcaagctccaggacgtcgttaaccagaatgcgcaggccctgaacactcttgtgaaacaattgagcagtaattttggtgctatctcttccgtactgaacgacatattaagccgactcgataaggtggaagccgaggtccagatcgacagactgattaccgggaggcttcagtcgctgcaaacgtacgtgacacagcagttgatccgcgcagctgagattcgggcctcagcaaatctcgccgctaccaagatgtctgaatgcgttctgggacagagtaaaagagtggatttctgtggcaagggttaccacctaatgtcctttccccaaagcgcgccacatggcgtcgtgttcctgcacgttacttatgtgccggcccaggagaaaaactttaccacagctcctgcaatctgccacgacgggaaggcccatttccccagggaaggagtctttgtatctaatggcactcactggttcgtgacccagcgcaacttttacgagccacagataattacaacggataataccttcgttagcgggaactgtgacgtggtcatcggaatcgtgaataacactgtatatgatcccctccaacctgagctggactccttcaaagaagaacttgataagtactttaaaaatcatacatcaccagacgtggatttgggcgacattagtggtatcaacgccagcgtcgttaatattcagaaggaaatagatcgactgaacgaggtggctaagaacttaaatgaatctctcatcgacctgcaggagcttgggaaatatgagcagtacattaagtggccctggtatatctggctgggattcattgcaggcctaatcgccatagtgatggtcaccatcatgctctgctgtatgacttcctgctgttcatgcctgaaaggttgttgcagttgtggcagctgctgcaagtttgacgaagatgactccgagcctgtgttgaaaggggttaagctgcactacacatga

SEQ ID NO: 11989 - RNA, 3822 nt, synthetic construct
  misc_feature 1..3822: note = SARS-CoV-2/Belgium/BA-02291/2020__EPI_ISL_415159 spike protein CDS human (1-1273)
  source 1..3822: mol_type = other RNA
atgttcgtgtttctggtcctccttcccctggttagctcccagtgcgtgaacttgaccacaagaactcaattacctccagcctacactaattctttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgagttccgtgtgtacagctccgcgaataactgtacttttgagtatgtgtcacaacctttcctgatggacctggaaggcaagcagggtaattttaaaaacctcagagagttcgtctttaagaacattgatgggtacttcaaaatctacagtaagcacaccccaataaatttagttagggacctgccccagggatttagcgctcttgagcctttggtggatctgccaatcggcattaacatcacacggttccagactctactcgccctgcatcgctcttatcttaccccgggcgactcctcaagcgggtggacagcaggagccgctgcatactatgtaggttacctgcaacccagaacctttttgctcaaatataatgaaaacggcacgattactgatgccgtggactgcgctctggatcctttaagtgagacaaagtgtaccctgaagtctttcactgtcgaaaaagggatctaccagacatccaattttagggtgcagccaaccgagagcatagttcggttccccaacattacgaatctctgcccttttggagaggtgttcaacgccacccgcttcgcgtcggtctatgcatggaatcgaaagagaatctctaactgtgtggccgactactccgtactttacaattcagctagttttagcacattcaaatgctatggcgtttccccaactaagctgaacgacttgtgttttaccaatgtgtacgccgattctttcgtcattaggggtgacgaagtgcggcagatcgcacccgggcaaacaggaaaaatcgctgattataactacaagctaccggacgattttactggctgcgtcattgcctggaatagcaacaacctggactcaaaagtgggcgggaattataactacctctatcgtctgttccgcagaagtaatcttaagccttttgagagggatatatccaccgaaatctaccaggcgggaagcacaccctgtaacggtgttgagggcttcaattgctactttccactgcagtcttatgggttccaacctaccaacggagtgggctaccagccctatcgggtagtcgtgttgtcatttgaactcctgccagcccccgcaactgtttgcggtcctaagaaaagtacgaatttagtgaagaacaaatgtgtcaatttcaactttaatgggctgacaggcaccggagtgctaactgagagcaacaagaaattcctcccattccagcagtttggccgagacattgctgataccacagacgccgtacgcgatccgcaaaccctggagatccttgacataactccctgctccttcgggggagtgtctgttattacacctggtacgaatacctcgaaccaggtcgctgtgttgtaccagggcgtgaattgtactgaagtcccagttgccatccacgcagaccagctgacacccacctggagagtgtatagcacagggtccaacgtgtttcaaactagggccggatgcctcatcggcgctgagcacgtaaacaattcatacgaatgtgatattcctatcggtgcggggatttgcgcaagttatcagacccagacgaactctccacggcgcgccagaagcgtcgcttcccagtcaataatcgcctacaccatgagcctgggcgcagaaaattctgtggcctactccaacaatagtattgctatccccacaaacttcactatcagcgttaccacagaaattcttccggtgtctatgactaagacctccgtcgactgtacgatgtatatatgcggagattcaacagagtgtagtaatctgttgctccaatacggcagcttttgcacccagctgaacagggccttaactgggatcgcagtggagcaggacaagaatacacaggaagttttcgcgcaagtgaaacagatttataagacccctccaatcaaagattttggaggtttcaacttttcgcagattctgcccgacccttccaagccctctaaacgtagcttcatcgaggatctactctttaataaggtaactctggctgacgccggcttcataaagcaatacggggattgtcttggagacatcgcagcccgggatttgatttgcgctcagaaattcaacggcctgaccgtcctcccacctctgttaacagacgaaatgatcgcccagtatacgtcagcactgcttgctggtaccattacgagtgggtggacatttggcgccggagcggccttgcagatccccttcgctatgcaaatggcataccgatttaatggcataggggtgacccagaacgtgctctatgagaatcagaagctgattgccaaccagttcaactccgctatcggaaaaattcaagattctctaagctccgccgcaccagcgctgggcaagctccaggacgtcgttaatcagaacgcccaggctctgaatacacttgtgaaacaattgtcaagcaactttggtgccatcagttctgtactgaatgacatattatccagactcgataaggtggaagcagaggtccagatcgacaggctgattactgggcgccttcagagcctgcaaacctacgtgacgcagcagttgatccgggctgccgagattagagcatcggccaacctcgctgcgacaaagatgtcagaatgcgttctgggacagtctaaaagggtggatttctgtggcaagggttaccatctaatgagttttccgcaatccgcccctcacggcgtcgtgttcctgcatgttacctatgtgcccgcacaggagaaaaattttactaccgctccagccatctgccacgacgggaaggcccacttcccccgcgaaggagtctttgtaagcaacggcacacattggttcgtgactcagcgaaatttttacgagcctcagataattaccacagataacacgttcgtttctgggaattgtgacgtggtcatcggaatcgtgaacaataccgtatatgatccactccaacccgagctggacagcttcaaagaagaacttgataagtactttaaaaaccacacttcccctgacgtggatttgggcgacatttcaggtatcaatgctagtgtcgttaacattcagaaggaaatagatcggctgaatgaggtggcaaagaacttaaacgaaagcctcatcgacctgcaggagcttgggaaatatgagcagtacattaagtggccgtggtatatctggctgggattcattgccggcctaatcgcgatagtgatggtcacaatcatgctctgctgtatgacctcttgctgttcctgcctgaaaggttgttgctcatgtggcagttgctgcaagtttgacgaagatgacagcgagccagtgttgaaaggggttaagctgcattacacttga

SEQ ID NO: 11990 - RNA, 3822 nt, synthetic construct
  misc_feature 1..3822: note = SARS-CoV-2/USA/WA8-UW5/2020__EPI_ISL_413486 spike protein CDS human (1-1273)
  source 1..3822: mol_type = other RNA
atgttcgtgtttctggtcctccttcccctggttagctcccagtgcgtgaacttgaccacaagaactcaattacctccagcctacactaattctttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgagttccgtgtgtacagctccgcgaataactgtacttttgaatatgtgtcacaacctttcctgatggacctggaaggcaagcagggtaattttaaaaacctcagagagttcgtctttaagaacattgatgggtacttcaaaatctacagtaagcacaccccaataaatttagttagggacctgccccagggatttagcgctcttgagcctttggtggatctgccaatcggcattaacatcacacggttccagactctactcgccctgcatcgctcttatcttaccccgggcgactcctcaagcgggtggacagcaggagccgctgcatactatgtaggttacctgcaacccagaacctttttgctcaaatataatgaaaacggcacgattactgatgccgtggactgcgctctggatcctttaagtgagacaaagtgtaccctgaagtctttcactgtcgaaaaagggatctaccagacatccaattttagggtgcagccaaccgagagcatagttcggttccccaacattacgaatctctgcccttttggagaggtgttcaacgccacccgcttcgcgtcggtctatgcatggaatcgaaagagaatctctaactgtgtggccgactactccgtactttacaattcagctagttttagcacattcaaatgctatggcgtttccccaactaagctgaacgacttgtgttttaccaatgtgtacgccgattctttcgtcattaggggtgacgaagtgcggcagatcgcacccgggcaaacaggaaaaatcgctgattataactacaagctaccggacgattttactggctgcgtcattgcctggaatagcaacaacctggactcaaaagtgggcgggaattataactacctctatcgtctgttccgcaagagtaatcttaagccttttgagagagatatatccaccgaaatctaccaggcgggaagcacaccctgtaacggtgttgagggcttcaattgctactttccactgcagtcttatgggttccaacctaccaacggagtgggctaccagccctatagggtagtcgtgttgtcatttgaactcctgcacgccccagcaactgtttgcggtcccaaaaagagtacgaatttagtgaaaaacaagtgtgtcaatttcaactttaatgggctgacaggcaccggagtgctaactgagagcaacaaaaagttcctccctttccagcagtttggccgggacattgctgataccacagacgccgtacgagatccacaaaccctggagatccttgacataactccgtgctccttcgggggagtgtctgttattacacccggtacgaatacctcgaaccaggtcgctgtgttgtaccaggacgtgaattgtactgaagtccctgttgccatccacgcagatcagctgacaccaacctggcgcgtgtatagcacaggctccaacgtgtttcaaactagagccgggtgcctcatcggagctgagtacgtaaacaattcatatgaatgtgacattcccatcggcgcgggtatttgcgcaagttaccagacccagacgaactctcctaggcgggcccgcagcgtcgcttcccagtcaataatcgcctacaccatgagcctgggggcagaaaattctgtggcctattccaacaatagtattgctatcccaacaaacttcactatcagcgttaccacagaaattcttcccgtgtctatgactaagacctccgtcgattgtacgatgtacatatgcggcgactcaacagagtgtagtaatctgttgctccaatatggcagcttttgcacccagctgaacagagccttaactggaatcgcagtggagcaggataaaaatacacaggaagttttcgcgcaagtgaagcagatttacaaaaccccgcctatcaaggactttgggggattcaacttttcgcagattctgccagatccctccaaaccttctaagaggagcttcatcgaggacctactctttaataaggtaactctggctgatgccggtttcataaaacaatatggcgactgtcttggggatatcgcagcccgtgacttgatttgcgctcagaagttcaacggactgaccgtcctgcccccactcttaacagatgaaatgatcgcccagtacacgtcagcactgcttgctggcaccattacgagtggttggacatttggggccggcgcggccttgcagatccctttcgctatgcaaatggcatatcggtttaatggaataggcgtgacccagaacgtgctctacgagaatcagaaactgattgccaaccagttcaactccgctatcgggaagattcaagactctctaagctccacagcctcagcactgggaaaactccaggacgtcgttaatcagaacgcgcaggccctgaatactcttgtgaagcaattgagcagtaactttggcgctatctcttccgtactgaatgatatattaagccgactcgacaaggtggaagccgaggtccagatcgatagactgattaccggtaggcttcagtcgctgcaaacgtacgtgacacagcagttgatccgcgcagctgagattcgggcctcagcaaacctcgccgctaccaaaatgtctgaatgcgttctggggcagagtaagagagtggacttctgtggaaaaggctatcatctaatgtcctttccccaaagcgcgccacacggtgtcgtgttcctgcatgttacttacgtgccggcccaggagaagaattttaccacagctcctgcaatctgccacgatggcaaagcccacttccccagggaaggggtctttgtatctaacggaactcattggttcgtgacccagcgcaatttttatgagccacagataattacaacggacaacaccttcgttagcggcaattgtgatgtggtcatcgggatcgtgaacaatactgtatacgaccccctccaacctgagctggattccttcaaggaggaacttgacaaatattttaagaaccacacatcaccagatgtggacttgggagatattagtggcatcaatgccagcgtcgttaacattcagaaggaaatagaccgactgaatgaggtggctaaaaacttaaacgaatctctcatcgacctgcaggagcttggtaagtacgagcagtatattaaatggccctggtacatctggctggggttcattgcaggactaatcgccatagtgatggtcaccatcatgctctgctgtatgacttcctgctgttcatgcctgaagggctgttgcagttgtggtagctgctgcaaatttgatgaagacgattccgagcctgtgttgaagggcgttaagctgcattacacatga

SEQ ID NO: 11991 - RNA, 3822 nt, synthetic construct
  misc_feature 1..3822: note = SARS-CoV-2/England/20102000506/2020__EPI_ISL_415147 spike protein CDS human (1-1273)
  source 1..3822: mol_type = other RNA
atgttcgtgtttctggtcctccttcccctggttagctcccagtgcgtgaacttgaccacaagaactcaattacctccagcctacactaattctttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgagttccgtgtgtacagctccgcgaataactgtacttttgagtatgtgtcacaacctttcctgatggacctggaaggcaagcagggtaattttaaaaacctcagagagttcgtctttaagaacattgatgggtacttcaaaatctacagtaagcacaccccaataaatttagttagggacctgccccagggatttagcgctcttgagcctttggtggatctgccaatcggcattaacatcacacggttccagactctactcgccctgcatcgctcttatcttaccccgggcgactcctcaagcgggtggacagcaggagccgctgcatactatgtaggttacctgcaacccagaacctttttgctcaaatataatgaaaacggcacgattactgatgccgtggactgcgctctggatcctttaagtgagacaaagtgtaccctgaagtctttcactgtcgaaaaagggatctaccagacatccaattttagggtgcagccaaccgagagcatagttcggttccccaacattacgaatctctgcccttttggagaggtgttcaacgccacccgcttcgcgtcggtctatgcatggaatcgaaagagaatctctaactgtgtggccgactactccgtactttacaattcagctagttttagcacattcaaatgctatggcgtttccccaactaagctgaacgacttgtgttttaccaatgtgtacgccgattctttcgtcattaggggtgacgaagtgcggcagatcgcacccgggcaaacaggaaaaatcgctgattataactacaagctaccggacgattttactggctgcgtcattgcctggaatagcaacaacctggactcaaaagtgggcgggaattataactacctctatcgtctgttccgcaagagtaatcttaagccttttgagagagatatatccaccgaaatctaccaggcgggaagcacaccctgtaacggtgttgagggcttcaattgctactttccactgcagtcttatgggttccaacctaccaacggagtgggctaccagccctatagggtagtcgtgttgtcatttgaactcctgcacgccccagcaactgtttgcggtcccaaaaagagtacgaatttagtgaaaaacaagtgtgtcaatttcaactttaatgggctgacaggcaccggagtgctaactgagagcaacaaaaagttcctccctttccagcagtttggccgggacattgctgataccacagacgccgtacgagatccacaaaccctggagatccttgacataactccgtgctccttcgggggagtgtctgttattacacccggtacgaatacctcgaaccaggtcgctgtgttgtaccagggcgtgaattgtactgaagtccctgttgccatccacgcagaccagctgacaccaacctggcgcgtgtatagcacagggtccaacgtgtttcaaactagagccggatgcctcatcggcgctgagcatgtaaacaattcatacgaatgtgatattcccatcggtgcggggatttgcgcaagttatcagacccagacgaactctcctaggcgggcccgcagcgtcgcttcccagtcaataatcgcctacaccatgagcctgggcgcagaaaattctgtggcctactccaacaatagtattgctatcccaacaaacttcactatcagcgttaccacagaaattcttcccgtgtctatgactaagacctccgtcgactgtacgatgtatatatgcggagattcaacagagtgtagtaatctgttgctccaatacggcagcttttgcacccagctgaacagagccttaactgggatcgcagtggagcaggacaaaaatacacaggaagttttcgcgcaagtgaagcagatttataaaaccccgcctatcaaggattttggaggtttcaacttttcgcagattctgccagacccctccaaaccttctaagaggagcttcatcgaggatctactctttaataaggtaactctggctgacgccggcttcataaaacaatacgggtattgtcttggagatatcgcagcccgtgacttgatttgcgctcagaagttcaacggcctgaccgtcctgcccccactcttaacagatgaaatgatcgcccagtacacgtcagcactgcttgctggtaccattacgagtgggtggacatttggcgccggagcggccttgcagatccctttcgctatgcaaatggcatatcggtttaatggcataggggtgacccagaacgtgctctacgagaatcagaaactgattgccaaccagttcaactccgctatcggaaagattcaagactctctaagctccacagcctcagcactgggcaaactccaggatgtcgttaatcagaacgcgcaggccctgaatactcttgtgaagcaattgagcagtaactttggtgctatctcttccgtactgaatgacatattaagccgactcgacaaggtggaagccgaggtccagatcgatagactgattaccgggaggcttcagtcgctgcaaacgtacgtgacacagcagttgatccgcgcagctgagattcgggcctcagcaaacctcgccgctaccaaaatgtctgaatgcgttctgggacagagtaagagagtggacttctgtggcaaaggttatcacctaatgtcctttccccaaagcgcgccacatggcgtcgtgttcctgcacgttacttacgtgccggcccaggagaagaattttaccacagctcctgcaatctgccacgatgggaaagcccatttccccagggaaggagtctttgtatctaacggcactcactggttcgtgacccagcgcaatttttatgagccacagataattacaacggacaacaccttcgttagcgggaattgtgatgtggtcatcggaatcgtgaacaatactgtatacgaccccctccaacctgagctggattccttcaaggaagaacttgacaaatattttaagaaccatacatcaccagatgtggacttgggcgatattagtggtatcaatgccagcgtcgttaacattcagaaggaaatagaccgactgaatgaggtggctaaaaacttaaacgaatctctcatcgatctgcaggagcttgggaagtacgagcagtatattaaatggccctggtacatctggctgggattcattgcaggcctaatcgccatagtgatggtcaccatcatgctctgctgtatgacttcctgctgttcatgcctgaagggttgttgcagttgtggcagctgctgcaaatttgacgaagacgattccgagcctgtgttgaagggggttaagctgcactacacatga

SEQ ID NO: 11992 - RNA, 3822 nt, synthetic construct
  misc_feature 1..3822: note = SARS-CoV-2/Belgium/VAG-03013/2020__EPI_ISL_415155 spike protein CDS human (1-1273)
  source 1..3822: mol_type = other RNA
atgttcgtgtttctggtcctccttcccctggttagctcccagtgcgtgaacttgaccacaagaactcaattacctccagcctacactaattctttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgagttccgtgtgtacagctccgcgaataactgtacttttgagtatgtgtcacaacctttcctgatggacctggaaggcaagcagggtaattttaaaaacctcagagagttcgtctttaagaacattgatgggtacttcaaaatctacagtaagcacaccccaataaatttagttagggacctgccccagggatttagcgctcttgagcctttggtggatctgccaatcggcattaacatcacacggttccagactctactcgccctgcatcgctcttatcttaccccgggcgactcctcaagcgggtggacagcaggagccgctgcatactatgtaggttacctgcaacccagaacctttttgctcaaatataatgaaaacggcacgattactgatgccgtggactgcgctctggatcctttaagtgagacaaagtgtaccctgaagtctttcactgtcgaaaaagggatctaccagacatccaattttagggtgcagccaaccgagagcatagttcggttccccaacattacgaatctctgcccttttggagaggtgttcaacgccacccgcttcgcgtcggtctatgcatggaatcgaaagagaatctctaactgtgtggccgactactccgtactttacaattcagctagttttagcacattcaaatgctatggcgtttccccaactaagctgaacgacttgtgttttaccaatgtgtacgccgattctttcgtcattaggggtgacgaagtgcggcagatcgcacccgggcaaacaggaaaaatcgctgattataactacaagctaccggacgattttactggctgcgtcattgcctggaatagcaacaacctggactcaaaagtgggcgggaattataactacctctatcgtctgttccgcaagagtaatcttaagccttttgagagagatatatccaccgaaatctaccaggcgggaagcacaccctgtaacggtgttgagggcttcaattgctactttccactgcagtcttatgggttccaacctaccaacggagtgggctaccagccctatagggtagtcgtgttgtcatttgaactcctgcacgccccagcaactgtttgcggtcccaaaaagagtacgaatttagtgaaaaacaagtgtgtcaatttcaactttaatgggctgacaggcaccggagtgctaactgagagcaacaaaaagttcctccctttccagcagtttggccgggacattgctgataccacagacgccgtacgagatccacaaaccctggagatccttgacataactccgtgctccttcgggggagtgtctgttattacacccggtacgaatacctcgaaccaggtcgctgtgttgtaccagggcgtgaattgtactgaagtccctgttgccatccacgcagaccagctgacaccaacctggcgcgtgtatagcacagggtccaacgtgtttcaaactagagccggatgcctcatcggcgctgagcatgtaaacaattcatacgaatgtgatattcccatcggtgcggggatttgcgcaagttatcagacccagacgaactctcctaggcgggcccgcagcgtcgcttcccagtcaataatcgcctacaccatgagcctgggcgcagaaaattctgtggcctactccaacaatagtattgctatcccaacaaacttcactatcagcgttaccacagaaattcttcccgtgtctatgactaagacctccgtcgactgtacgatgtatatatgcggagattcaacagagtgtagtaatctgttgctccaatacggcagcttttgcacccagctgaacagagccttaactgggatcgcagtggagcaggacaaaaatacacaggaagttttcgcgcaagtgaagcagatttataaaaccccgcctatcaaggattttggaggtttcaacttttcgcagattctgccagacccctccaaaccttctaagaggagcttcatcgaggatctactctttaataaggtaactctggctgacgccggcttcataaaacaatacggggattgtcttggagacatcgcagcccgtgatttgatttgcgctcagaagttcaacggcctgaccgtcctgcccccactcttaacagacgaaatgatcgcccagtatacgtcagcactgcttgctggtaccattacgagtgggtggacatttggcgccggagcggccttgcagatccctttcgctatgcaaatggcataccggtttaatggcataggggtgacccagaacgtgctctatgagaatcagaaactgattgccaaccagttcaactccgctatcggaaagattcaagattctctaagctccacagccactgcactgggcaaactccaggacgtcgttaatcagaacgcgcaggccctgaatacccttgtgaagcaattgtcaagcaactttggtgctatcagttctgtactgaatgacatattatcccgactcgataaggtggaagccgaggtccagatcgacagactgattacggggaggcttcagagcctgcaaacatacgtgacccagcagttgatccgcgcagctgagattcgggcctcggcaaacctcgccgctactaaaatgtcagaatgcgttctgggacagtctaagagagtggatttctgtggcaaaggttaccacctaatgagttttccccaatccgcgccacatggcgtcgtgttcctgcacgttacctatgtgccggcccaggagaagaattttacaactgctcctgcaatctgccacgacgggaaagcccatttccccagggaaggagtctttgtaagcaacggcacccactggttcgtgacacagcgcaatttttacgagccacagataattacgaccgataacactttcgtttctgggaattgtgacgtggtcatcggaatcgtgaacaatacagtatatgatcccctccaacctgagctggacagcttcaaggaagaacttgataaatactttaagaaccatacctccccagacgtggatttgggcgacatttcaggtatcaatgccagtgtcgttaacattcagaaggaaatagatcgactgaatgaggtggctaaaaacttaaacgaaagcctcatcgacctgcaggagcttgggaagtatgagcagtacattaaatggccctggtatatctggctgggattcattgcaggcctaatcgccatagtgatggtcactatcatgctctgctgtatgacatcttgctgttcctgcctgaagggttgttgctcatgtggcagttgctgcaaatttgacgaagatgacagcgagcctgtgttgaagggggttaagctgcactacacctga

SEQ ID NO: 11993 - RNA, 3822 nt, synthetic construct
  misc_feature 1..3822: note = SARS-CoV-2/Belgium/BC-03016/2020__EPI_ISL_415157 spike protein CDS human (1-1273)
  source 1..3822: mol_type = other RNA
atgttcgtgtttctggtcctccttcccctggttagctcccagtgcgtgaacttgaccacaagaactcaattacctccagcctacactaattctttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgagttccgtgtgtacagctccgcgaataactgtacttttgagtatgtgtcacaacctttcctgatggacctggaaggcaagcagggtaattttaaaaacctcagagagttcgtctttaagaacattgatgggtacttcaaaatctacagtaagcacaccccaataaatttagttagggacctgccccagggatttagcgctcttgagcctttggtggatctgccaatcggcattaacatcacacggttccagactctactcgccctgcatcgctcttatcttaccccgggcgactcctcaagcgggtggacagcaggagccgctgcatactatgtaggttacctgcaacccagaacctttttgctcaaatataatgaaaacggcacgattactgatgccgtggactgcgctctggatcctttaagtgagacaaagtgtaccctgaagtctttcactgtcgaaaaagggatctaccagacatccaattttagggtgcagccaaccgagagcatagttcggttccccaacattacgaatctctgcccttttggagaggtgttcaacgccacccgcttcgcgtcggtctatgcatggaatcgaaagagaatctctaactgtgtggccgactactccgtactttacaattcagctagttttagcacattcaaatgctatggcgtttccccaactaagctgaacgacttgtgttttaccaatgtgtacgccgattctttcgtcattaggggtgacgaagtgcggcagatcgcacccgggcaaacaggaaaaatcgctgattataactacaagctaccggacgattttactggctgcgtcattgcctggaatagcaacaacctggactcaaaagtgggcgggaattataactacctctatcgtctgttccgcaagagtaatcttaagccttttgagagagatatatccaccgaaatctaccaggcgggaagcacaccctgtaacggtgttgagggcttcaattgctactttccactgcagtcttatgggttccaacctaccaacggagtgggctaccagccctatagggtagtcgtgttgtcatttgaactcctgcacgccccagcaactgtttgcggtcccaaaaagagtacgaatttagtgaaaaacaagtgtgtcaatttcaactttaatgggctgacaggcaccggagtgctaactgagagcaacaaaaagttcctccctttccagcagtttggccgggacattgctgataccacagacgccgtacgagatccacaaaccctggagatccttgacataactccgtgctccttcgggggagtgtctgttattacacccggtacgaatacctcgaaccaggtcgctgtgttgtaccagggcgtgaattgtactgaagtccctgttgccatccacgcagaccagctgacaccaacctggcgcgtgtatagcacagggtccaacgtgtttcaaactagagccggatgcctcatcggcgctgagcatgtaaacaattcatacgaatgtgatattcccatcggtgcggggatttgcgcaagttatcagacccagacgaactctcctaggcgggcccgcagcgtcgcttcccagtcaataatcgcctacaccatgagcctgggcgcagaaaattctgtggcctactccaacaatagtattgctatcccaacaaacttcactatcagcgttaccacagaaattcttcccgtgtctatgactaagacctccgtcgactgtacgatgtatatatgcggagattcaacagagtgtagtaatctgttgctccaatacggcagcttttgcacccagctgaacagagccttaactgggatcgcagtggagcaggacaaaaatacacaggaagttttcgcgcaagtgaagcagatttataaaaccccgcctatcaaggattttggaggtttcaacttttcgcagattctgccagacccctccaaaccttctaagaggagcttcatcgaggatctactctttaataaggtaactctggctgacgccggcttcataaaacaatacggggattgtcttggagacatcgcagcccgtgatttgatttgcgctcagaagttcaacggcctgaccgtcctgcccccactcttaacagacgaaatgatcgcccagtatacgtcagcactgcttgctggtaccattacgagtgggtggacatttggcgccggagcggccttgcagatccctttcgctatgcaaatggcataccggtttaatggcataggggtgacccagaacgtgctctatgagaatcagaaactgattgccaaccagttcaactccgctatcggaaagattcaagattctctaagctccacagcccccgcactgggcaaactccaggacgtcgttaatcagaacgcgcaggccctgaatactcttgtgaagcaattgtcaagcaactttggtgctatcagttctgtactgaatgacatattatcccgactcgataaggtggaagccgaggtccagatcgacagactgattaccgggaggcttcagagcctgcaaacgtacgtgacacagcagttgatccgcgcagctgagattcgggcctcggcaaacctcgccgctaccaaaatgtcagaatgcgttctgggacagtctaagagagtggatttctgtggcaaaggttaccacctaatgagttttccacaatccgcgccgcatggcgtcgtgttcctgcacgttacttatgtgcctgcccaggagaagaattttaccacagcacccgctatctgccacgacgggaaagcccatttcccaagggaaggagtctttgtaagcaacggcactcactggttcgtgacccagcgcaatttttacgagccccagataattacaacggataacaccttcgtttctgggaattgtgacgtggtcatcggaatcgtgaacaatactgtatatgatcctctccaaccagagctggacagcttcaaggaagaacttgataaatactttaagaaccatacatcccccgacgtggatttgggcgacatttcaggtatcaatgccagtgtcgttaacattcagaaggaaatagatcgactgaatgaggtggctaaaaacttaaacgaaagcctcatcgacctgcaggagcttgggaagtatgagcagtacattaaatggccttggtatatctggctgggattcattgcaggcctaatcgccatagtgatggtcaccatcatgctctgctgtatgacttcttgctgttcctgcctgaagggttgttgctcatgtggcagttgctgcaaatttgacgaagatgacagcgagccggtgttgaagggggttaagctgcactacacatga

SEQ ID NO: 11994 - RNA, 3822 nt, synthetic construct
  misc_feature 1..3822: note = SARS-CoV-2/Germany/BavPat3/2020__EPI_ISL_414521 spike protein CDS human (1-1273)
  source 1..3822: mol_type = other RNA
atgttcgtgtttctggtcctccttcccctggttagctcccagtgcgtgaacttgaccacaagaactcaattacctccagcctacactaattctttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgagttccgtgtgtacagctccgcgaataactgtacttttgaatatgtgtcacaacctttcctgatggacctggaaggcaagcagggtaattttaaaaacctcagagagttcgtctttaagaacattgatgggtacttcaaaatctacagtaagcacaccccaataaatttagttagggacctgccccagggatttagcgctcttgagcctttggtggatctgccaatcggcattaacatcacacggttccagactctactcgccctgcatcgctcttatcttaccccgggcgactcctcaagcgggtggacagcaggagccgctgcatactatgtaggttacctgcaacccagaacctttttgctcaaatataatgaaaacggcacgattactgatgccgtggactgcgctctggatcctttaagtgagacaaagtgtaccctgaagtctttcactgtcgaaaaagggatctaccagacatccaattttagggtgcagccaaccgagagcatagttcggttccccaacattacgaatctctgcccttttggagaggtgttcaacgccacccgcttcgcgtcggtctatgcatggaatcgaaagagaatctctaactgtgtggccgactactccgtactttacaattcagctagttttagcacattcaaatgctatggcgtttccccaactaagctgaacgacttgtgttttaccaatgtgtacgccgattctttcgtcattaggggtgacgaagtgcggcagatcgcacccgggcaaacaggaaaaatcgctgattataactacaagctaccggacgattttactggctgcgtcattgcctggaatagcaacaacctggactcaaaagtgggcgggaattataactacctctatcgtctgttccgcaagagtaatcttaagccttttgagagagatatatccaccgaaatctaccaggcgggaagcacaccctgtaacggtgttgagggcttcaattgctactttccactgcagtcttatgggttccaacctaccaacggagtgggctaccagccctatagggtagtcgtgttgtcatttgaactcctgcacgccccagcaactgtttgcggtcccaaaaagagtacgaatttagtgaaaaacaagtgtgtcaatttcaactttaatgggctgacaggcaccggagtgctaactgagagcaacaaaaagttcctccctttccagcagtttggccgggacattgctgataccacagacgccgtacgagatccacaaaccctggagatccttgacataactccgtgctccttcgggggagtgtctgttattacacccggtacgaatacctcgaaccaggtcgctgtgttgtaccaggacgtgaattgtactgaagtccctgttgccatccacgcagatcagctgacaccaacctggcgcgtgtatagcacaggctccaacgtgtttcaaactagagccgggtgcctcatcggagctgagcatgtaaacaattcatacgaatgtgacattcccatcggcgcgggtatttgcgcaagttatcagacccagacgaactctcctaggcgggcccgcagcgtcgcttcccagtcaataatcgcctacaccatgagcctgggggcagaaaattctgtggcctactccaacaatagtattgctatcccaacaaacttcactatcagcgttaccacagaaattcttcccgtgtctatgactaagacctccgtcgattgtacgatgtatatatgcggcgactcaacagagtgtagtaatctgttgctccaatacggcagcttttgcacccagctgaacagagccttaactggaatcgcagtggagcaggataaaaatacacagcaagttttcgcacaggtgaagcagatttataaaaccccgcctatcaaggactttgggggattcaacttttcgcaaattctgccagatccctccaaaccttctaagaggagcttcatcgaagacctactctttaataaggtaactctggctgatgccggtttcataaaacagtacggcgactgtcttggggatatcgcagcccgtgacttgatttgcgctcagaagttcaacggactgaccgtcctgcccccactcttaacagatgagatgatcgcccagtatacgtcagcactgcttgctggcaccattacgagtggttggacatttggggccggcgcggccttgcaaatccctttcgctatgcagatggcataccggtttaatggaataggcgtgacccagaacgtgctctatgaaaatcagaaactgattgccaaccaattcaactccgctatcgggaagattcaggactctctaagctccacagcctcagcactgggaaaactccaggacgtcgttaatcagaacgcgcaagccctgaatactcttgtgaagcagttgagcagtaactttggcgctatctcttccgtactgaatgatatattaagccgactcgacaaggtggaggccgaagtccagatcgatagactgattaccggtaggcttcaatcgctgcagacgtacgtgacacagcagttgatccgcgcagctgagattcgggcctcagcaaacctcgccgctaccaaaatgtctgagtgcgttctggggcaaagtaagagagtggacttctgtggaaaaggctaccacctaatgtcctttccccagagcgcgccacatggtgtcgtgttcctgcacgttacttatgtgccggcccaggaaaagaattttaccacagcgcctgctatctgccacgatggcaaagcccatttccccagggagggggtctttgtatctaacggaactcactggttcgtgacccagcgcaatttttacgaaccacaaataattacaacggacaacaccttcgttagcggcaattgtgatgtggtcatcgggatcgtgaacaatactgtatatgaccccctccagcctgagctggattccttcaaggaggaacttgacaaatactttaagaaccatacatcaccagatgtggacttgggagatattagtggcatcaatgccagcgtcgttaacattcagaaggagatagaccgactgaatgaagtggctaaaaacttaaacgagtctctcatcgacctgcaggaacttggtaagtatgagcaatacattaaatggccctggtatatctggctggggttcattgcaggactaatcgccatagtgatggtcaccatcatgctctgctgtatgacttcctgctgttcatgcctgaagggctgttgcagttgtggtagctgctgcaaatttgatgaggacgattccgaacctgtgttgaagggcgttaagctgcactacacatga

SEQ ID NO: 11995 - RNA, 3822 nt, synthetic construct
  misc_feature 1..3822: note = SARS-CoV-2/France/HF1805/2020__EPI_ISL_414628 spike protein CDS human (1-1273)
  source 1..3822: mol_type = other RNA
atgttcgtgtttctggtcctccttcccctggttagctcccagtgcgtgaacttgaccacaagaactcaattacctccagcctacactaattctttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgagttccgtgtgtacagctccgcgaataactgtacttttgagtatgtgtcacaacctttcctgatggacctggaaggcaagcagggtaattttaaaaacctcagagagttcgtctttaagaacattgatgggtacttcaaaatctacagtaagcacaccccaataaatttagttagggacctgccccagggatttagcgctcttgagcctttggtggatctgccaatcggcattaacatcacacggttccagactctactcgccctgcatcgctcttatcttaccccgggcgactcctcaagcgggtggacagcaggagccgctgcatactatgtaggttacctgcaacccagaacctttttgctcaaatataatgaaaacggcacgattactgatgccgtggactgcgctctggatcctttaagtgagacaaagtgtaccctgaagtctttcactgtcgaaaaagggatctaccagacatccaattttagggtgcagccaaccgagagcatagttcggttccccaacattacgaatctctgcccttttggagaggtgttcaacgccacccgcttcgcgtcggtctatgcatggaatcgaaagagaatctctaactgtgtggccgactactccgtactttacaattcagctagttttagcacattcaaatgctatggcgtttccccaactaagctgaacgacttgtgttttaccaatgtgtacgccgattctttcgtcattaggggtgacgaagtgcggcagatcgcacccgggcaaacaggaaaaatcgctgattataactacaagctaccggacgattttactggctgcgtcattgcctggaatagcaacaacctggactcaaaagtgggcgggaattataactacctctatcgtctgttccgcaagagtaatcttaagccttttgagagagatatatccaccgaaatctaccaggcgggaagcacaccctgtaacggtgttgagggcttcaattgctactttccactgcagtcttatgggttccaacctaccaacggagtgggctaccagccctatagggtagtcgtgttgtcatttgaactcctgcacgccccagcaactgtttgcggtcccaaaaagagtacgaatttagtgaaaaacaagtgtgtcaatttcaactttaatgggctgacaggcaccggagtgctaactgagagcaacaaaaagttcctccctttccagcagtttggccgggacattgctgataccacagacgccgtacgagatccacaaaccctggagatccttgacataactccgtgctccttcgggggagtgtctgttattacacccggtacgaatacctcgaaccaggtcgctgtgttgtaccagggcgtgaattgtactgaagtccctgttgccatccacgcagaccagctgacaccaacctggcgcgtgtatagcacagggtccaacgtgtttcaaactagagccggatgcctcatcggcgctgagcatgtaaacaattcatacgaatgtgatattcccatcggtgcggggatttgcgcaagttatcagacccagacgaactctcctaggcgggcccgcagcgtcgcttcccagtcaataatcgcctacaccatgagcctgggcgcagaaaattctgtggcctactccaacaatagtattgctatcccaacaaacttcactatcagcgttaccacagaaattcttcccgtgtctatgactaagacctccgtcgactgtacgatgtatatatgcggagattcaacagagtgtagtaatctgttgctccaatacggcagcttttgcacccagctgaacagagccttaactgggatcgcagtggagcaggacaaaaatacacaggaagttttcgcgcaagtgaagcagatttataaaaccccgcctatcaaggattttggaggtttcaacttttcgcagattctgccagacccctccaaaccttctaagaggagcttcatcgaggatctactctttaataaggtaactctggctgacgccggcttcataaaacaatacggggattgtcttggagacatcgcagcccgtgatttgatttgcgctcagaagttcaacggcctgaccgtcctgcccccactcttaacagacgaaatgatcgcccagtatacgtcagcactgcttgctggtaccattacgagtgggtggacatttggcgccggagcggccttgcagatccctttcgctatgcaaatggcataccggtttaatggcataggggtgacccagaacgtgctctatgagaatcagaaactgattgccaaccagttcaactccgctatcggaaagattcaagattctctaagctccacagcctcagcactgggcaaactccaggacgtcgttaatcagaacgcgcaggccctgaatactcttgtgaagcaattgagcagtaactttggtgctatctcttccgtactgaatgacatattaagccgactcgataaggtggaagccgaggtccagatcgacagactgattaccgggaggcttcagtcgctgcaaacgtacgtgacacagcagttgatccgcgcagctgagattcgggcctcagcaaacctcgccgctaccaaaatgtctgaatgcgttctgggacagagtaagagagtggatttctgtggcaaaggttaccacctaatgtcctttccccaaagcgcgccacatggcgtcgtgttcctgcacgttacttatgtgccggcccaggagaagaattttaccacagctcctgcaatctgccacgacgggaaagcccatttccccagggaaggagtctttgtatctaacggcactcactggttcgtgacccagcgcaatttttacgagccacagataattacaacggataacaccttcgttagcgggaattgtgacgtggtcatcggagtggtaaacaatactgtgtatgatcccctccaacctgagctggactccttcaaggaagaacttgataaatactttaagaaccatacatcaccagacgtcgatttgggcgacatcagtggtattaatgccagcgttgtgaacatccagaaggaaattgatcgactgaatgaggtggctaaaaacttaaacgaatctctcatagacctgcaggagcttgggaagtatgagcagtacatcaaatggccctggtatatttggctgggattcatcgcaggcctaattgccatcgtcatggtgaccataatgctctgctgtatgacttcctgctgttcatgcctgaagggttgttgcagttgtggcagctgctgcaaatttgacgaagatgactccgagcctgttttgaagggggtaaagctgcactacacatga

SEQ ID NO: 11996 - RNA, 3822 nt, synthetic construct
  misc_feature 1..3822: note SARS-CoV-2/Netherlands/ZuidHolland_9/2020__EPI_ISL_414445 spike protein CDS human (1-1273)
  source 1..3822: mol_type = other RNA
atgttcgtgtttctggtcctccttcccctggttagctcccagtgcgtgaacttgaccacaagaactcaattacctccagcctacactaattctttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgagttccgtgtgtacagctccgcgaataactgtacttttgagtatgtgtcacaacctttcctgatggacctggaaggcaagcagggtaattttaaaaacctcagagagttcgtctttaagaacattgatgggtacttcaaaatctacagtaagcacaccccaataaatttagttagggacctgccccagggatttagcgctcttgagcctttggtggatctgccaatcggcattaacatcacacggttccagactctactcgccctgcatcgctcttatcttaccccgggcgactcctcaagcgggtggacagcaggagccgctgcatactatgtaggttacctgcaacccagaacctttttgctcaaatataatgaaaacggcacgattactgatgccgtggactgcgctctggatcctttaagtgagacaaagtgtaccctgaagtctttcactgtcgaaaaagggatctaccagacatccaattttagggtgcagccaaccgagagcatagttcggttccccaacattacgaatctctgcccttttggagaggtgttcaacgccacccgcttcgcgtcggtctatgcatggaatcgaaagagaatctctaactgtgtggccgactactccgtactttacaattcagctagttttagcacattcaaatgctatggcgtttccccaactaagctgaacgacttgtgttttaccaatgtgtacgccgattctttcgtcattaggggtgacgaagtgcggcagatcgcacccgggcaaacaggaaaaatcgctgattataactacaagctaccggacgattttactggctgcgtcattgcctggaatagcaacaacctggactcaaaagtgggcgggaattataactacctctatcgtctgttccgcaagagtaatcttaagccttttgagagagatatatccaccgaaatctaccaggcgggaagcacaccctgtaacggtgttgagggcttcaattgctactttccactgcagtcttatgggttccaacctaccaacggagtgggctaccagccctatagggtagtcgtgttgtcatttgaactcctgcacgccccagcaactgtttgcggtcccaaaaagagtacgaatttagtgaaaaacaagtgtgtcaatttcaactttaatgggctgacaggcaccggagtgctaactgagagcaacaaaaagttcctccctttccagcagtttggccgggacattgctgataccacagacgccgtacgagatccacaaaccctggagatccttgacataactccgtgctccttcgggggagtgtctgttattacacccggtacgaatacctcgaaccaggtcgctgtgttgtaccagggcgtgaattgtactgaagtccctgttgccatccacgcagaccagctgacaccaacctggcgcgtgtatagcacagggtccaacgtgtttcaaactagagccggatgcctcatcggcgctgagcatgtaaacaattcatacgaatgtgatattcccatcggtgcggggatttgcgcaagttatcagacccagacgaactctcctaggcgggcccgcagcgtcgcttcccagtcaataatcgcctacaccatgagcctgggcgcagaaaattctgtggcctactccaacaatagtattgctatcccaacaaacttcactatcagcgttaccacagaaattcttcccgtgtctatgactaagacctccgtcgactgtacgatgtatatatgcggagattcaacagagtgtagtaatctgttgctccaatacggcagcttttgcacccagctgaacagagccttaactgggatcgcagtggagcaggacaaaaatacacaggaagttttcgcgcaagtgaagcagatttataaaaccccgcctatcaaggattttggaggtttcaacttttcgcagattctgccagacccctccaaaccttctaagaggagcttcatcgaggatctactctttaataaggtaactctggctgacgccggcttcataaaacaatacggggattgtcttggagacatcgcagcccgtgatttgatttgcgtccagaagttcaacggcctgaccgtgctgcccccactcttaacagacgaaatgatcgctcagtatacgtcagccctgcttgcaggtaccattacgagtgggtggacatttggcgctggagccgcgttgcagatccctttcgccatgcaaatggcttaccggtttaatggcataggggtgacccagaacgtcctctatgagaatcagaaactgattgcaaaccagttcaactccgccatcggaaagattcaagattctctaagctccacagcttcagccctgggcaaactccaggacgttgtgaatcagaacgcacaggcgctgaatactcttgtaaagcaattgagcagtaactttggtgccatctcttccgtgctgaatgacatattaagccgactcgataaggtcgaagctgaggtgcagatcgacagactgattaccgggaggcttcagtcgctgcaaacgtacgttacacagcagttgatccgcgccgcagagattcgggcttcagccaacctcgcagccaccaaaatgtctgaatgcgtgctgggacagagtaagagagtcgatttctgtggcaaaggttaccacctaatgtcctttccccaaagcgctccacatggcgtggttttcctgcacgtgacttatgtcccggcgcaggagaagaattttaccacagcccctgcaatctgccacgacgggaaagctcatttccccagggaaggagtatttgtgtctaacggcactcactggttcgttacccagcgcaatttttacgagccacagataattacaacggataacaccttcgtgagcgggaattgtgacgtcgtgatcggaatcgtaaacaatactgtgtatgatcccctccaacctgagctggactccttcaaggaagaacttgataaatactttaagaaccatacatcaccagacgtcgatttgggcgacattagtggtatcaatgccagcgttgtgaacattcagaaggaaatagatcgactgaatgaggtggccaaaaacttaaacgaatctctcatcgacctgcaggagcttgggaagtatgagcagtacattaaatggccctggtatatctggctgggattcattgctggcctaatcgcaatagtcatggtgaccatcatgctctgctgtatgacttcctgctgttcatgcctgaagggttgttgcagttgtggcagctgctgcaaatttgacgaagatgactccgagcctgttttgaagggggtaaagctgcactacacatga

SEQ ID NO: 11997 - RNA, 3822 nt, synthetic construct
  misc_feature 1..3822: note = SARS-CoV-2/Finland/FIN03032020A/2020__EPI_ISL_413602 spike protein CDS human (1-1273)
  source 1..3822: mol_type = other RNA
atgttcgtgtttctggtcctccttcccctggttagctcccagtgcgtgaacttgaccacaagaactcaattacctccagcctacaccaattctttcacgaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgagttccgtgtgtacagctccgcgaataactgtacttttgagtatgtgtcacaacctttcctgatggacctggaaggcaagcagggtaattttaaaaacctcagagagttcgtctttaagaacattgatgggtacttcaaaatctacagtaagcacaccccaataaatttagttagggacctgccccagggatttagcgctcttgagcctttggtggatctgccaatcggcattaacatcacacggttccagactctactcgccctgcatcgctcttatcttaccccgggcgactcctcaagcgggtggacagcaggagccgctgcatactatgtaggttacctgcaacccagaacctttttgctcaaatataatgaaaacggcacgattactgatgccgtggactgcgctctggatcctttaagtgagacaaagtgtaccctgaagtctttcactgtcgaaaaagggatctaccagacatccaattttagggtgcagccaaccgagagcatagttcggttccccaacattacgaatctctgcccttttggagaggtgttcaacgccacccgcttcgcgtcggtctatgcatggaatcgaaagagaatctctaactgtgtggccgactactccgtactttacaattcagctagttttagcacattcaaatgctatggcgtttccccaactaagctgaacgacttgtgttttaccaatgtgtacgccgattctttcgtcattaggggtgacgaagtgcggcagatcgcacccgggcaaacaggaaaaatcgctgattataactacaagctaccggacgattttactggctgcgtcattagctggaactcaaataacctggacagtaaagtgggcgggaattataactacctctatcgtctgttccgcaagtccaatcttaagccttttgagagagatataagcaccgaaatctaccaggccggatctacaccctgtaacggtgttgagggcttcaattgctactttccactgcagtcatatgggttccaacctaccaacggagtgggctaccagccctatagggtagtcgtgttgagttttgaactcctgcacgcgccagccactgtttgcggtcccaaaaagagcacgaatttagtgaaaaacaagtgtgtcaatttcaactttaatgggctgacaggcaccggagtgctaactgagtccaacaaaaagttcctccctttccagcagtttggccgggacattgcagataccacagacgctgtacgagatccacaaaccctggagatccttgacataactccgtgctctttcgggggagtgtcggttattacacccggtacgaataccagcaaccaggtcgccgtgttgtaccagggcgtgaattgtactgaagtccctgttgctatccacgccgaccagctgacaccaacctggcgcgtgtattccacagggtcaaacgtgtttcaaactagagcaggatgcctcatcggcgccgagcatgtaaacaatagttacgaatgtgatattcccatcggtgctgggatttgcgcgtcttatcagacccagacgaacagccctaggcgggcacgctccgtcgcctcacagagcataatcgcttacaccatgtctctgggcgccgaaaattccgtggcatacagtaacaatagcattgccatcccaacaaacttcactatctctgttaccacagaaattcttcccgtgtccatgactaagacctcagtcgactgtacgatgtatatatgcggagatagtacagagtgtagcaatctgttgctccaatacggctcgttttgcacccagctgaacagagctttaactgggatcgccgtggagcaggacaaaaatacacaggaagttttcgcacaagtgaagcagatttataaaaccccgcctatcaaggattttggaggtttcaacttttcccagattctgccagacccctctaaacctagcaagaggtcattcatcgaggatctactctttaataaggtaactctggcggacgctggcttcataaaacaatacggggattgtcttggagacatcgccgcacgtgatttgatttgcgcccagaagttcaacggcctgaccgtcctgcccccactcttaacagacgaaatgatcgctcagtatacgagtgccctgcttgcaggtaccattacttccgggtggacatttggcgctggagccgcgttgcagatccctttcgccatgcaaatggcttaccggtttaatggcataggggtgacccagaacgtgctctatgagaatcagaaactgattgcaaaccagttcaactctgccatcggaaagattcaagatagcctatcctcaacagctagcgccctgggcaaactccaggacgtcgttaatcagaacgcacaggcgctgaatactcttgtgaagcaattgagttctaactttggtgccatctccagcgtactgaatgacatattatcgcgactcgataaggtggaagctgaggtccagatcgacagactgattaccgggaggcttcagtcactgcaaacgtacgtgacacagcagttgatccgcgccgcagagattcgggcttctgccaacctcgcagccaccaaaatgagtgaatgcgttctgggacagtccaagagagtggatttctgtggcaaaggttaccacctaatgagctttccccaatctgctccacatggcgtcgtgttcctgcacgttacttatgtgccggcgcaggagaagaattttaccacagcccctgcaatctgccacgacgggaaagctcatttccccagggaaggagtctttgtaagcaacggcactcactggttcgtgacccagcgcaatttttacgagccacagataattacaacggataacaccttcgtttccgggaattgtgacgtggtcatcggaatcgtgaacaatactgtatatgatcccctccaacctgagctggactcattcaaggaagaacttgataaatactttaagaaccatacaagtccagacgtggatttgggcgacattagcggtatcaatgcctctgtcgttaacattcagaaggaaatagatcgactgaatgaggtggccaaaaacttaaacgaatccctcatcgacctgcaggagcttgggaagtatgagcagtacattaaatggccctggtatatctggctgggattcattgctggcctaatcgcaatagtgatggtcaccatcatgctctgctgtatgacttcatgctgtagttgcctgaagggttgttgcagctgtggctcctgctgcaaatttgacgaagatgactctgagcctgtgttgaagggggttaagctgcactacacatga

SEQ ID NO: 11998 - RNA, 3822 nt, synthetic construct
  misc_feature 1..3822: note = SARS-CoV-2/France/GE1977/2020__EPI_ISL_414632 spike protein CDS human (1-1273)
  source 1..3822: mol_type = other RNA
atgttcgtgtttctggtcctccttcccctggttagctcccagtgcgtgaacttgaccacaagaactcaattacctccagcctacactaattctttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgagttccgtgtgtacagctccgcgaataactgtacttttgagtatgtgtcacaacctttcctgatggacctggaaggcaagcagggtaattttaaaaacctcagagagttcgtctttaagaacattgatgggtacttcaaaatctacagtaagcacaccccaataaatttagttagggacctgccccagggatttagcgctcttgagcctttggtggatctgccaatcggcattaacatcacacggttccagactctactcgccctgcatcgctcttatcttaccccgggcgactcctcaagcgggtggacagcaggagccgctgcatactatgtaggttacctgcaacccagaacctttttgctcaaatataatgaaaacggcacgattactgatgccgtggactgcgctctggatcctttaagtgagacaaagtgtaccctgaagtctttcactgtcgaaaaagggatctaccagacatccaattttagggtgcagccaaccgagagcatagttcggttccccaacattacgaatctctgcccttttggagaggtgttcaacgccacccgcttcgcgtcggtctatgcatggaatcgaaagagaatctctaactgtgtggccgactactccgtactttacaattcagctagttttagcacattcaaatgctatggcgtttccccaactaagctgaacgacttgtgttttaccaatgtgtacgccgattctttcgtcattaggggtgacgaagtgcggcagatcgcacccgggcaaacaggaaaaatcgctgattataactacaagctaccggacgattttactggctgcgtcattgcctggaatagcaacaacctggactcaaaagtgggcgggaattataactacctctatcgtctgttccgcaagagtaatcttaagccttttgagagagatatatccaccgaaatctaccaggcgggaagcacaccctgtaacggtgttgagggcttcaattgctactttccactgcagtcttatgggttccaacctaccaacggagtgggctaccagccctatagggtagtcgtgttgtcatttgaactcctgcacgccccagcaactgtttgcggtcccaaaaagagtacgaatttagtgaaaaacaagtgtgtcaatttcaactttaatgggctgacaggcaccggagtgctaactgagagcaacaaaaagttcctccctttccagcagtttggccgggacattgctgataccacagacgccgtacgagatccacaaaccctggagatccttgacataactccgtgctccttcgggggagtgtctgttattacacccggtacgaatacctcgaaccaggtcgctgtgttgtaccagggcgtgaattgtactgaagtccctgttgccatccacgcagaccagctgacaccaacctggcgcgtgtatagcacagggtccaacgtgtttcaaactagagccggatgcctcatcggcgctgagcatgtaaacaattcatacgaatgtgatattcccatcggtgcggggatttgcgcaagttatcagacccagacgaactctcctaggcgggcccgcagcgtcgcttcccagtcaataatcgcctacaccatgagcctgggcgcagaaaattctgtggcctactccaacaatagtattgctatcccaacaaacttcactatcagcgttaccacagaaattcttcccgtgtctatgactaagacctccgtcgactgtacgatgtatatatgcggagattcaacagagtgtagtaatctgttgctccaatacggcagcttttgcacccagctgaacagagccttaactgggatcgcagtggagcaggacaaaaatacacaggaagttttcgcgcaagtgaagcagatttataaaaccccgcctatcaaggattttggaggtttcaacttttcgcagattctgccagacccctccaaaccttctaagaggagcttcatcgaggatctactctttaataaggtaactctggctgacgccggcttcataaaacaatacggggattgtcttggagacatcgcagcccgtgatttgatttgcgctcagaagttcaacggcctgaccgtcctgcccccactcttaacagacgaaatgatcgcccagtatacgtcagcactgcttgctggtaccattacgagtgggtggacatttggcgccggagcggccttgcagatccctttcgctatgcaaatggcataccggtttaatggcataggggtgacccagaacgtgctctatgagaatcagaaactgattgccaaccagttcaactccgctatcggaaagattcaagattctctatttagcacagcctccgcactgggcaaactccaggacgtcgttaatcagaacgcgcaggccctgaatactcttgtgaagcaattgtcaagcaacttcggtgctatcagttctgtactgaatgacatattatcccgactcgataaggtggaagccgaggtccagatcgacagactgattaccgggaggcttcagagcctgcaaacgtacgtgacacagcagttgatccgcgcagctgagattcgggcctcggcaaacctcgccgctaccaaaatgtcagaatgcgttctgggacagtctaagagagtggatttttgtggcaaaggttaccacctaatgagtttcccccaatccgcgccacatggcgtcgtgtttctgcacgttacttatgtgccggcccaggagaagaatttcaccacagctcctgcaatctgccacgacgggaaagcccattttcccagggaaggagtcttcgtaagcaacggcactcactggtttgtgacccagcgcaatttctacgagccacagataattacaacggataacaccttcgtttctgggaattgtgacgtggtcatcggaatcgtgaacaatactgtatatgatcccctccaacctgagctggacagctttaaggaagaacttgataaatacttcaagaaccatacatccccagacgtggatttgggcgacatttcaggtatcaatgccagtgtcgttaacattcagaaggaaatagatcgactgaatgaggtggctaaaaacttaaacgaaagcctcatcgacctgcaggagcttgggaagtatgagcagtacattaaatggccctggtatatctggctgggatttattgcaggcctaatcgccatagtgatggtcaccatcatgctctgctgtatgacttcttgctgttcctgcctgaagggttgttgctcatgtggcagttgctgcaaattcgacgaagatgacagcgagcctgtgttgaagggggttaagctgcactacacatga

SEQ ID NO: 11999 - RNA, 3822 nt, synthetic construct
  misc_feature 1..3822: note = SARS-CoV-2/Finland/FIN-313/2020__EPI_ISL_414641 spike protein CDS human (1-1273)
  source 1..3822: mol_type = other RNA
atgttcgtgtttctggtcctccttcccctggttagctcccagtgcgtgaacttgaccacaagaactcaattacctccagcctacactaattctttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgagttccgtgtgtacagctccgcgaataactgtacttttgagtatgtgtcacaacctttcctgatggacctggaaggcaagcagggtaattttaaaaacctcagagagttcgtctttaagaacattgatgggtacttcaaaatctacagtaagcacaccccaataaatttagttagggacctgccccagggatttagcgctcttgagcctttggtggatctgccaatcggcattaacatcacacggttcaaaactctactcgccctgcatcgctcttatcttaccccgggcgactcctcaagcgggtggacagcaggagccgctgcatactatgtaggttacctgcagcccagaacctttttgctcaagtataatgaaaacggcacgattactgatgccgtggactgcgctctggatcctttaagtgagacaaagtgtaccctgaaatctttcactgtcgaaaaggggatctaccaaacatccaattttagggtgcagccaaccgagagcatagttcggttccccaacattacgaatctctgcccttttggagaggtgttcaacgccacccgcttcgcgtcggtctatgcatggaatcgaaaaagaatctctaactgtgtggccgactactccgtactttacaattcagctagttttagcacattcaagtgctatggcgtttccccaactaaactgaacgacttgtgttttaccaatgtgtacgccgattctttcgtcattaggggtgacgaagtgcggcagatcgcacccgggcagacaggaaagatcgctgattataactacaaactaccggacgattttactggctgcgtcattgcctggaatagcaacaacctggactcaaaggtgggcgggaattataactacctctatcgtctgttccgcaagagtaatcttaaaccttttgagagagatatatccaccgaaatctaccaagcgggaagcacaccctgtaacggtgttgagggcttcaattgctactttccactgcagtcttatgggttccagcctaccaacggagtgggctaccaaccctatagggtagtcgtgttgtcatttgaactcctgcacgccccagcaactgtttgcggtcccaagaaaagtacgaatttagtgaagaacaaatgtgtcaatttcaactttaatgggctgacaggcaccggagtgctaactgagagcaacaagaagttcctccctttccagcagtttggccgggacattgctgataccacagacgccgtacgagatccacagaccctggagatccttgacataactccgtgctccttcgggggagtgtctgttattacacccggtacgaatacctcgaaccaagtcgctgtgttgtaccagggcgtgaattgtactgaagtccctgttgccatccacgcagaccagctgacaccaacctggcgcgtgtatagcacagggtccaacgtgtttcagactagagccggatgcctcatcggcgctgagcatgtaaacaattcatacgaatgtgatattcccatcggtgcggggatttgcgcaagttatcaaacccagacgaactctcctaggcgggcccgcagcgtcgcttcccagtcaataatcgcctacaccatgagcctgggcgcagaaaattctgtggcctactccaacaatagtattgctatcccaacaaacttcactatcagcgttaccacagaaattcttcccgtgtctatgactaaaacctccgtcgactgtacgatgtatatatgcggagattcaacagagtgtagtaatctgttgctccagtacggcagcttttgcacccaactgaacagagccttaactgggatcgcagtggagcaggacaagaatacacaggaagttttcgcacaggtgaaacaaatttataagaccccgcctatcaaagattttggaggtttcaacttttcgcagattctgccagacccctccaagccttctaagaggagcttcatcgaggatctactctttaataaagtaactctggctgacgccggcttcataaagcagtacggggattgtcttggagacatcgcagcccgtgatttgatttgcgctcaaaaattcaacggcctgaccgtcctgcccccactcttaacagacgaaatgatcgcccagtatacgtcagcactgcttgctggtaccattacgagtgggtggacatttggcgccggagcggccttgcagatccctttcgctatgcagatggcataccggtttaatggcataggggtgacccaaaacgtgctctatgagaatcagaagctgattgccaaccagttcaactccgctatcggaaaaattcaggattctctaagctccacagcctcagcactgggcaagctccaagacgtcgttaatcagaacgcgcaggccctgaatactcttgtgaagcagttgagcagtaactttggtgctatctcttccgtactgaatgacatattaagccgactcgataaagtggaagccgaggtccaaatcgacagactgattaccgggaggcttcagtcgctgcagacgtacgtgacacaacagttgatccgcgcagctgagattcgggcctcagcaaacctcgccgctaccaagatgtctgaatgcgttctgggacagagtaaaagagtggatttctgtggcaagggttaccacctaatgtcctttccccagagcgcgccacatggcgtcgtgttcctgcacgttacttatgtgccggcccaagagaaaaattttaccacagcgcctgctatctgccacgacgggaaggcccatttccccagggaaggagtctttgtatctaacggcactcactggttcgtgacccagcgcaatttttacgagccacagataattacaacggataacaccttcgttagcgggaattgtgacgtggtcatcggaatcgtgaacaatactgtatatgatcccctccagcctgagctggactccttcaaagaagaacttgataagtactttaagaaccatacatcaccagacgtggatttgggcgacattagtggtatcaatgccagcgtcgttaacattcaaaaagaaatagatcgactgaatgaggtggctaagaacttaaacgaatctctcatcgacctgcaggagcttgggaaatatgagcagtacattaagtggccctggtatatctggctgggattcattgcaggcctaatcgccatagtgatggtcaccatcatgctctgctgtatgacttcctgctgttcatgcctgaaaggttgttgcagttgtggcagctgctgcaagtttgacgaagatgactccgagcctgtgttgaagggggttaaactgcactacacatga

SEQ ID NO: 12000 - RNA, 3822 nt, synthetic construct
  misc_feature 1..3822: note SARS-CoV-2/Netherlands/ZuidHolland_2/2020__EPI_ISL_414556 spike protein CDS human (1-1273)
  source 1..3822: mol_type = other RNA
atgttcgtgtttctggtcctccttcccctggttagctcccagtgcgtgaacttgaccacaagaactcaattacctccagcctacactaattctttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgagttccgtgtgtacagctccgcgaataactgtacttttgaatatgtgtcacaacctttcctgatggacctggaaggcaagcagggtaattttaaaaacctcagagagttcgtctttaagaacattgatgggtacttcaaaatctacagtaagcacaccccaataaatttagttagggacctgccccagggatttagcgctcttgagcctttggtggatctgccaatcggcattaacatcacacggttccagactctactcgccctgcatcgctcttatcttaccccgggcgactcctcaagcgggtggacagcaggagccgctgcatactatgtaggttacctgcaacccagaacctttttgctcaaatataatgaaaacggcacgattactgatgccgtggactgcgctctggatcctttaagtgagacaaagtgtaccctgaagtctttcactgtcgaaaaagggatctaccagacatccaattttagggtgcagccaaccgagagcatagttcggttccccaacattacgaatctctgcccttttggagaggtgttcaacgccacccgcttcgcgtcggtctatgcatggaatcgaaagagaatctctaactgtgtggccgactactccgtactttacaattcagctagttttagcacattcaaatgctatggcgtttccccaactaagctgaacgacttgtgttttaccaatgtgtacgccgattctttcgtcattaggggtgacgaagtgcggcagatcgcacccgggcaaacaggaaaaatcgctgattataactacaagctaccggacgattttactggctgcgtcattgcctggaatagcaacaacctggactcaaaagtgggcgggaattataactacctctatcgtctgttccgcaagagtaatcttaagccttttgagagagatatatccaccgaaatctaccaggcgggaagcacaccctgtaacggtgttgagggcttcaattgctactttccactgcagtcttatgggttccaacctaccaacggagtgggctaccagccctatagggtagtcgtgttgtcatttgaactcctgcacgccccagcaactgtttgcggtcccaaaaagagtacgaatttagtgaaaaacaagtgtgtcaatttcaactttaatgggctgacaggcaccggagtgctaactgagagcaacaaaaagttcctccctttccagcagtttggccgggacattgctgataccacagacgccgtacgagatccacaaaccctggagatccttgacataactccgtgctccttcgggggagtgtctgttattacacccggtacgaatacctcgaaccaggtcgctgtgttgtaccagggcgtgaattgtactgaagtccctgttgccatccacgcagaccagctgacaccaacctggcgcgtgtatagcacagggtccaacgtgtttcaaactagagccggatgcctcatcggcgctgagcatgtaaacaattcatacgaatgtgatattcccatcggtgcggggatttgcgcaagttatcagacccagacgaactctcctaggcgggcccgcagcgtcgcttcccagtcaataatcgcctacaccatgagcctgggcgcagaaaattctgtggcctactccaacaatagtattgctatcccaacaaacttcactatcagcgttaccacagaaattcttcccgtgtctatgactaagacctccgtcgactgtacgatgtatatatgcggagattcaacagagtgtagtaatctgttgctccaatacggcagcttttgcacccagctgaacagagccttaactgggatcgcactggagcaggacaaaaatacacaggaagtgttcgcgcaagttaagcagatttataaaaccccgcctatcaaggattttggaggtttcaacttttcgcagattctaccagacccctccaaaccttctaagaggagcttcatcgaggatctcctgtttaataaggtgactcttgctgacgccggcttcataaaacaatacggggattgtttgggagacatcgcagcccgtgatctgatttgcgctcagaagttcaacggcctcaccgtactgcccccattactgacagacgaaatgatcgcccagtatacgtcagcacttttggctggtaccattacgagtgggtggacatttggcgccggagcggccctccagatccctttcgctatgcaaatggcataccggtttaatggcataggggtcacccagaacgtgctgtatgagaatcagaaactaattgccaaccagttcaactccgctatcggaaagattcaagattctctgagctccacagcctcagcactcggcaaactgcaggacgtggtcaatcagaacgcgcaggcccttaatactttggttaagcaactgagcagtaactttggtgctatctcttccgtgttaaatgacatactcagccgactggataaggtagaagccgaggtgcagatcgacagacttattaccgggaggctgcagtcgttgcaaacgtacgtcacacagcagctcatccgcgcagctgagattcgggcctcagcaaacctggccgctaccaaaatgtctgaatgcgtgctaggacagagtaagagagttgatttctgtggcaaaggttaccacctgatgtcctttccccaaagcgcgccacatggcgtggtcttcctccacgtgacttatgttccggcccaggagaagaattttaccacagctcctgcaatctgccacgacgggaaagcccatttccccagggaaggagtgtttgtctctaacggcactcactggttcgtaacccagcgcaatttttacgagccacagataattacaacggataacaccttcgtgagcgggaattgtgacgttgtgatcggaatcgtcaacaatactgtgtatgatcccctgcaacctgagcttgactccttcaaggaagagttggataaatactttaagaaccatacatcaccagacgtagatctgggcgacattagtggtatcaatgccagcgtggtcaacattcagaaggaaatagatcgattaaatgaggttgctaaaaacctcaacgaatctctgatcgaccttcaggagctggggaagtatgagcagtacattaaatggccctggtatatctggctaggattcattgcaggcctcatcgccatagtgatggtgaccatcatgctgtgctgtatgacttcctgctgttcatgcttgaagggttgttgcagttgtggcagctgctgcaaatttgacgaagatgactccgagcctgtcctgaagggggtgaagttacactacacatga

SEQ ID NO: 12001 - RNA, 3822 nt, synthetic construct
  misc_feature 1..3822: note = SARS-CoV-2/USA/WA-UW31/2020__EPI_ISL_414618 spike protein CDS human (1-1273)
  source 1..3822: mol_type = other RNA
atgttcgtgtttctggtcctccttcccctggttagctcccagtgcgtgaacttgaccacaagaactcaattacctccagcctacactaattctttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgagttccgtgtgtacagctccgcgaataactgtacttttgaatatgtgtcacaacctttcctgatggacctggaaggcaagcagggtaattttaaaaacctcagagagttcgtctttaagaacattgatgggtacttcaaaatctacagtaagcacaccccaataaatttagttagggacctgccccagggatttagcgctcttgagcctttggtggatctgccaatcggcattaacatcacacggttccagactctactcgccctgcatcgctcttatcttaccccgggcgactcctcaagcgggtggacagcaggagccgctgcatactatgtaggttacctgcaacccagaacctttttgctcaaatataatgaaaacggcacgattactgatgccgtggactgcgctctggatcctttaagtgagacaaagtgtaccctgaagtctttcactgtcgaaaaagggatctaccagacatccaattttagggtgcagccaaccgagagcatagttcggttccccaacattacgaatctctgcccttttggagaggtgttcaacgccacccgcttcgcgtcggtctatgcatggaatcgaaagagaatctctaactgtgtggccgactactccgtactttacaattcagctagttttagcacattcaaatgctatggcgtttccccaactaagctgaacgacttgtgttttaccaatgtgtacgccgattctttcgtcattaggggtgacgaagtgcggcagatcgcacccgggcaaacaggaaaaatcgctgattataactacaagctaccggacgattttactggctgcgtcattgcctggaatagcaacaacctggactcaaaagtgggcgggaattataactacctctatcgtctgttccgcaagagtaatcttaagccttttgagagagatatatccaccgaaatctaccaggcgggaagcacaccctgtaacggtgccgagggcttcaattgctactttccactgcagtcttatgggttccaacctaccaacggagttggctaccagccctatagggtggtagtcttgtcatttgaactcctgcacgcaccagctactgtgtgcggtcccaaaaagagtacgaatttagttaaaaacaagtgtgtgaatttcaactttaatgggctgacaggcaccggagtcctaactgagagcaacaaaaagttcctccctttccagcagtttggccgggacattgccgataccacagacgctgtgcgagatccacaaaccctggagatccttgacataactccgtgctccttcgggggagtatctgtgattacacccggtacgaatacctcgaaccaggttgccgtcttgtaccaggacgtgaattgtactgaagtgcctgtcgcaatccacgccgatcagctgacaccaacctggcgcgtttatagcacaggctccaacgtgtttcaaactagagctgggtgcctcatcggagcggagcatgtgaacaattcatacgaatgtgacattcccatcggcgcaggtatttgcgccagttatcagacccagacgaactctcctaggcgggctcgcagcgtagcctcccagtcaataatcgcatacaccatgagcctgggggccgaaaattctgtcgcttactccaacaatagtattgccatcccaacaaacttcactatcagcgtgaccacagaaattcttcccgtttctatgactaagacctccgtggattgtacgatgtatatatgcggcgactcaacagagtgtagtaatctgttgctccaatacggcagcttttgcacccagctgaacagagcattaactggaatcgcggtcgagcaggataaaaatacacaggaagtgttcgctcaagttaagcagatttataaaaccccgcctatcaaggactttgggggattcaacttttcgcagattctgccagatccctccaaaccttctaagaggagcttcatcgaggacctactctttaataaggtgactctggccgatgcaggtttcataaaacaatacggcgactgtcttggggatatcgccgctcgtgacttgatttgcgcccagaagttcaacggactgaccgtactgcccccactcttaacagatgaaatgatcgcacagtatacgtcagctctgcttgccggcaccattacgagtggttggacatttggggcgggcgccgctttgcagatccctttcgcaatgcaaatggcctaccggtttaatggaataggcgtcacccagaacgtgctctatgagaatcagaaactgattgctaaccagttcaactccgccatcgggaagattcaagactctctaagctccacagcatcagcgctgggaaaactccaggacgtggtcaatcagaacgcccaggctctgaatactcttgttaagcaattgagcagtaactttggcgccatctcttccgtgctgaatgatatattaagccgactcgacaaggtagaagcagaggtgcagatcgatagactgattaccggtaggcttcagtcgctgcaaacgtacgtcacacagcagttgatccgcgctgccgagattcgggcatcagccaacctcgctgcgaccaaaatgtctgaatgcgtgctggggcagagtaagagagttgacttctgtggaaaaggctaccacctaatgtcctttccccaaagcgccccacatggtgtggtcttcctgcacgtgacttatgttccggcacaggagaagaattttaccacagctcctgccatctgccacgatggcaaagcccatttccccagggaaggggtgtttgtctctaacggaactcactggttcgtaacccagcgcaatttttacgagccacagataattacaacggacaacaccttcgtgagcggcaattgtgatgttgtgatcgggatcgtcaacaatactgtgtatgaccccctccaacctgagctggattccttcaaggaggaacttgacaaatactttaagaaccatacatcaccagatgtagacttgggagatattagtggcatcaatgctagcgtggtcaacattcagaaggaaatagaccgactgaatgaggttgccaaaaacttaaacgaatctctcatcgacctgcaggagcttggtaagtatgagcagtacattaaatggccctggtatatctggctggggttcattgcaggactaatcgcgatagtgatggtgaccatcatgctctgctgtatgacttcctgctgttcatgcctgaagggctgttgcagttgtggtagctgctgcaaatttgatgaagacgattccgagcctgtcttgaagggcgtgaagctgcactacacatga

SEQ ID NO: 12002 - RNA, 3822 nt, synthetic construct
  misc_feature 1..3822: note = SARS-CoV-2/South Korea/SNU01/2020__EPI_ISL_411929 spike protein CDS human (1-1273)
  source 1..3822: mol_type = other RNA
atgttcgtgtttctggtcctccttcccctggttagctcccagtgcgtgaacttgaccacaagaactcaattacctccagcctacaccaattctttcacgaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgagttccgtgtgtacagctccgcgaataactgtacttttgaatatgtgtcacaacctttcctgatggacctggaaggcaagcagggtaattttaaaaacctcagagagttcgtctttaagaacattgatgggtacttcaaaatctacagtaagcacaccccaataaatttagttagggacctgccccagggattttgggctcttgagcctttggtggatctgccaatcggcattaacatcacacggttccagactctactcgccctgcatcgcagctatcttaccccgggcgactcttcctcagggtggacagcaggagccgctgcatactatgtaggttacctgcaacccagaacctttttgctcaaatataatgaaaacggcacgattactgatgccgtggactgcgctctggatcctttaagcgagacaaagtgtaccctgaagagtttcactgtcgaaaaagggatctaccagacatctaattttagggtgcagccaaccgagtccatagttcggttccccaacattacgaatctctgcccttttggagaggtgttcaacgccacccgcttcgcgagcgtctatgcatggaatcgaaagagaatctcgaactgtgtggccgactactctgtactttacaattccgcttcatttagtacattcaaatgctatggcgttagcccaactaagctgaacgacttgtgttttaccaatgtgtacgccgattccttcgtcattaggggtgacgaagtgcggcagatcgcacccgggcaaacaggaaaaatcgctgattataactacaagctaccggacgattttactggctgcgtcattgcctggaactctaataacctggacagcaaagtgggcgggaattataactacctctatcgtctgttccgcaagtcaaatcttaagccttttgagagagatataagtaccgaaatctaccaggcgggatccacaccctgtaacggtgttgagggcttcaattgctactttccactgcagagctatgggttccaacctaccaacggagtgggctaccagccctatagggtagtcgtgttgtcttttgaactcctgcacgccccagcaactgtttgcggtcccaaaaagtcaacgaatttagtgaaaaacaagtgtgtcaatttcaactttaatgggctgacaggcaccggagtgctaactgagagtaacaaaaagttcctccctttccagcagtttggccgggacattgctgataccacagacgccgtacgagatccacaaaccctggagatccttgacataactccgtgcagcttcgggggagtgtccgttattacacccggtacgaatacctctaaccaggtcgctgtgttgtaccaggacgtgaattgtactgaagtccctgttgccatccacgcagatcagctgacaccaacctggcgcgtgtattcgacaggcagcaacgtgtttcaaactagagccgggtgcctcatcggagctgagcatgtaaacaattcctacgaatgtgacattcccatcggcgcgggtatttgcgcatcatatcagacccagacgaacagtcctaggcgggcccgctctgtcgctagccagtccataatcgcctacaccatgtcactgggggcagagaatagcgtggcctactctaacaattccattgctatcccaacaaacttcactatcagtgttaccacagaaattcttcccgtgagcatgactaagacctctgtcgattgtacgatgtatatatgcggcgactccacagagtgttcaaatctgttgctccaatacggaagtttttgcacccagctgaacagagccttaactggcatcgcagtggagcaggataaaaatacacaggaagttttcgcgcaagtgaagcagatttataaaaccccgcctatcaaggactttgggggattcaactttagccagattctgccagatccctcgaaaccttccaagaggtctttcatcgaggacctactctttaataaggtaactctggctgatgccggtttcataaaacaatacggcgactgtcttggggatatcgcagcccgtgacttgatttgcgctcagaagttcaacggactgaccgtcctccctccactgttaacagatgaaatgatcgcccagtatacgagcgcactgcttgctggcaccattacttcaggttggacatttggggccggcgcggccttgcagatccctttcgctatgcaaatggcataccggtttaatggaataggcgtgacccagaacgtgctctatgagaatcagaaactgattgccaaccagttcaacagtgctatcgggaagattcaagactccctatctagcacagcctccgcactgggaaaactccaggacgtcgttaatcagaacgcgcaggccctgaatactcttgtgaagcaattgtcaagcaactttggcgctatcagttctgtactgaatgatatattatcccgactcgacaaggtggaagccgaggtccagatcgatagactgattaccggtaggcttcagagcctgcaaacgtacgtgacacagcagttgatccgcgcagctgagattcgggcctcggcaaacctcgccgctaccaaaatgtcagaatgcgttctggggcagtctaagagagtggacttctgtggaaaaggctaccacctaatgagttttccccaatccgcgccacatggtgtcgtgttcctgcacgttacttatgtgccggcccaggagaagaattttaccacagcacccgctatctgccacgatggcaaagcccatttccccagggaaggggtctttgtaagcaacggaactcactggttcgtgacccagcgcaatttttacgagccacagataattacaacggacaacaccttcgtttctggcaattgtgatgtggtcatcgggatcgtgaacaatactgtatatgaccccctccaacctgagctggatagcttcaaggaagaacttgacaaatactttaagaaccatacatccccagatgtggacttgggagatatttcaggcatcaatgccagtgtcgttaacattcagaaggaaatagaccgactgaatgaggtggctaaaaacttaaacgaaagcctcatcgacctgcaggagcttggtaagtatgagcagtacattaaatggccctggtatatctggctggggttcattgcaggactaatcgccatagtgatggtcaccatcatgctctgctgtatgacttcttgctgttcctgcctgaagggctgttgctcatgtggtagttgctgcaaatttgatgaagacgatagcgagcctgtgttgaagggcgttaagctgcactacacatga

SEQ ID NO: 12003 - RNA, 3822 nt, synthetic construct
  misc_feature 1..3822: note = SARS-CoV-2/China/WF0004/2020__EPI_ISL_413694 spike protein CDS human (1-1273)
  source 1..3822: mol_type = other RNA
atgttcgtgtttctggtcctccttcccctggttagctcccagtgcgtgaacttgaccacaagaactcaattacctccagcctacacgaatagcttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggactgagtctgagttccgtgtgtacagctccgcgaataactgtacctttgagtatgtgtcacaacctttcctgatggacctggaaggcaagcagggtaattttaaaaacctcagagagttcgtctttaagaacattgatgggtacttcaaaatctacagtaagcacacaccaataaatttagttagggacctgccccagggatttagcgctcttgagcctttggtggatctgccaatcggcattaacatcactcggttccagaccctactcgccctgcatcgctcttatcttacaccgggcgactcctcaagcgggtggaccgcaggagccgctgcatactatgtaggttacctgcaacccagaacgtttttgctcaaatataatgaaaacggcactattacagatgccgtggactgcgctctggatcctttaagtgagaccaagtgtactctgaagtctttcacagtcgaaaaagggatctaccagacctccaattttagggtgcagccaacggagagcatagttcggttccccaacattaccaatctctgcccttttggagaggtgttcaacgccacacgcttcgcgtcggtctatgcatggaatcgaaagagaatctctaactgtgtggccgactactccgtactttacaattcagctagttttagcactttcaaatgctatggcgtttccccaaccaagctgaacgacttgtgttttacaaatgtgtacgccgattctttcgtcattaggggtgacgaagtgcggcagatcgcacccgggcaaactggaaaaatcgctgattataactacaagctaccggacgattttaccggctgcgtcattgcctggaatagcaacaacctggactcaaaagtgggcgggaattataactacctctatcgtctgttccgcaagagtaatcttaagccttttgagagagatatatccacagaaatctaccaggcgggaagcaccccctgtaacggtgttgagggcttcaattgctactttccactgcagtcttatgggttccaacctactaacggagtgggctaccagccctatagggtagtcgtgttgtcatttgaactcctgcacgccccagcaacggtttgcggtcccaaaaagagtacaaatttagtgaaaaacaagtgtgtcaatttcaactttaatgggctgaccggcactggagtgctaaccgagagcaacaaaaagttcctccctttccagcagtttggccgggacattgctgatacaaccgacgccgtacgagatccacaaactctggagatccttgacataacaccgtgctccttcgggggagtgtctgttattacgcccggtaccaatacttcgaaccaggtcgctgtgttgtaccaggacgtgaattgtacagaagtccctgttgccatccacgcagatcagctgaccccaacatggcgcgtgtatagcactggctccaacgtgtttcaaaccagagccgggtgcctcatcggagctgagcatgtaaacaattcatacgaatgtgacattcccatcggcgcgggtatttgcgcaagttatcagacgcagaccaactctcctaggcgggcccgcagcgtcgcttcccagtcaataatcgcctacacaatgagcctgggggcagaaaattctgtggcctactccaacaatagtattgctatcccaactaacttcaccatcagcgttacaactgaaattcttcccgtgtctatgaccaagacgtccgtcgattgtacaatgtatatatgcggcgactcaaccgagtgtagtaatctgttgctccaatacggatctttttgcactcagctgaacagagccttaacaggcatcgcagtggagcaggataaaaatacccaggaagttttcgcgcaagtgaagcagatttataaaactccgcctatcaaggactttgggggattcaacttttcgcagattctgccagatccctccaaaccttctaagaggagcttcatcgaggacctactctttaataaggtaaccctggctgatgccggtttcataaaacaatacggcgactgtcttggggatatcgcagcccgtgacttgatttgcgctcagaagttcaacggactgacagtcctgcccccactcttaacggatgaaatgatcgcccagtatacctcagcactgcttgctggcactattacaagtggttggacctttggggccggcgcggccttgcagatccctttcgctatgcaaatggcataccggtttaatggaataggcgtgacacagaacgtgctctatgagaatcagaaactgattgccaaccagttcaactccgctatcgggaagattcaagactctctaagctccactgcctcagcactgggaaaactccaggacgtcgttaatcagaacgcgcaggccctgaatacccttgtgaagcaattgagcagtaactttggcgctatctcttccgtactgaatgatatattaagccgactcgacaaggtggaagccgaggtccagatcgatagactgattacgggtaggcttcagtcgctgcaaacatacgtgacccagcagttgatccgcgcagctgagattcgggcctcagcaaacctcgccgctactaaaatgtctgaatgcgttctggggcagagtaagagattcgacttttgtggaaaaggctaccacctaatgtccttcccccaaagcgcgccacatggtgtggtctttctgcacgtgacctatgttccggcccaggagaagaatttcacaactgctcctgcaatctgccacgatggcaaagcccattttcccagggaaggggtgttcgtctctaacggaacccactggtttgtaacacagcgcaatttctacgagccacagataattacgaccgacaacactttcgtgagcggcaattgtgatgttgtgatcgggatcgtcaacaatacagtgtatgaccccctccaacctgagctggattcctttaaggaagaacttgacaaatacttcaagaaccatacctcaccagatgtagacttgggagatattagtggcatcaatgccagcgtggtcaacattcagaaggaaatagaccgactgaatgaggttgctaaaaacttaaacgaatctctcatcgacctgcaggagcttggtaagtatgagcagtacattaaatggccctggtatatctggctggggtttattgcaggactaatcgccatagtgatggtgactatcatgctctgctgtatgacatcctgctgttcatgcctgaagggctgttgcagttgtggtagctgctgcaaattcgatgaagacgattccgagcctgtcttgaagggcgtgaagctgcactacacctga

SEQ ID NO: 12004 - RNA, 3822 nt, synthetic construct
  misc_feature 1..3822: note = SARS-CoV-2/China/WF0028/2020__EPI_ISL_413791 spike protein CDS human (1-1273)
  source 1..3822: mol_type = other RNA
atgttcgtgtttctggtcctccttcccctggttagctcccagtgcgtgaacttgaccacaagaactcaattacctccagcctacactaattctttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgagttccgtgtgtacagctccgcgaataactgtacttttgaatatgtgtcacaacctttcctgatggacctggaaggcaagcagggtaattttaaaaacctcagagagttcgtctttaagaacattgatgggtacttcaaaatctacagtaagcacaccccaataaatttagttagggacctgccccagggatttagcgctcttgagcctttggtggatctgccaatcggcattaacatcacacggttccagactctactcgccctgcatcgctcttatcttaccccgggcgactcctcaagcgggtggacagcaggagccgctgcatactatgtaggttacctgcaacccagaacctttttgctcaaatataatgaaaacggcacgattactgatgccgtggactgcgctctggatcctttaagtgagacaaagtgtaccctgaagtctttcactgtcgaaaaagggatctaccagacatccaattttagggtgcagccaaccgagagcatagttcggttccccaacattacgaatctctgcccttttggagaggtgttcaacgccacccgcttcgcgtcggtctatgcatggaatcgaaagagaatctctaactgtgtggccgactactccgtactttacaattcagctagttttagcacattcaaatgctatggcgtttccccaactaagctgaacgacttgtgttttaccaatgtgtacgccgattctttcgtcattaggggtgacgaagtgcggcagatcgcacccgggcaaacaggaaaaatcgctgattataactacaagctaccggacgattttactggctgcgtcattgcctggaatagcaacaacctggactcaaaagtgggcgggaattataactacctctatcgtctgttccgcaagagtaatcttaagccttttgagagagatatatccaccgaaatctaccaggcgggaagcacaccctgtaacggtgttgagggcttcaattgctactttccactgcagtcttatgggttccaacctaccaacggagtgggctaccagccctatagggtagtcgtgttgtcatttgaactcctgcacgccccagcaactgtttgcggtcccaaaaagagtacgaatttagtgaaaaacaagtgtgtcaatttcaactttaatgggctgacaggcaccggagtgctaactgagagcaacaaaaagttcctccctttccagcagtttggccgggacattgctgataccacagacgccgtacgagatccacaaaccctggagatccttgacataactccgtgctccttcgggggagtgtctgttattacacccggtacgaatacctcgaaccaggtcgctgtgttgtaccaggacgtgaattgtactgaagtccctgttgccatccacgcagatcagctgacaccaacctggcgcgtgtatagcacaggctccaacgtgtttcaaactagagccgggtgcctcatcggagctgagcatgtaaacaattcatacgaatgtgacattcccatcggcgcgggtatttgcgcaagttatcagacccagacgaactctcctaggcgggcccgcagcgtcgcttcccagtcaataatcgcctacaccatgagcctgggggcagaaaattctgtggcctactccaacaatagtattgctatcccaacaaacttcactatcagcgttaccacagaaattcttcccgtgtctatgactaagacctccgtcgattgtacgatgtatatatgcggcgactcaacagagtgtagtaatctgttgctccaatacggcagcttttgcacccagctgaacagagccttaactggaatcgcagtggagcaggataaaaatacacaggaagttttcgcgcaagtgaagcagatttataaaaccccgcctatcaaggactttgggggattcaacttttcgcagattctgccagatccctccaaaccttctaagaggagcttcatcgaggacctactctttaataaggtaactctggctgatgccggtttcataaaacaatacggcgactgtcttggggatatcgcagcccgtgacttgatttgcgctcagaagttcaacggactgaccgtcctgcccccactcttaacagatgaaatgatcgcccagtatacgtcagcactgcttgctggcaccattacgagtggttggacatttggggccggcgcggccttgcagatccctttcgctatgcaaatggcataccggtttaatggaataggcgtgacccagaacgtgctctatgagaatcagaaactgattgccaaccagttcaactccgctatcgggaagattcaagactctctaagctccacagcctcagcactgggaaaactccaggacgtcgttaatcagaacgcgcaggccctgaatactcttgtgaagcaattgagcagtaactttggcgctatctcttccgtactgaatgatatattaagccgactcgacaaggtggaagccgaggtccagatcgatagactgattaccggtaggcttcagtcgctgcaaacgtacgtgacacagcagttgatccgcgcagctgagattcgggcctcagcaaacctcgccgctaccaaaatgtctgaatgcgttctggggcagagtaagagagtggacttctgtggaaaaggctaccacctaatgtcctttccccaaagcgcgccacatggtgtcgtgttcctgcacgttacttatgtgccggcccaggagaagaattttaccacagctcctgcaatctgccacgatggcaaagcccatttccccagggaaggggtctttgtatctaacggaactcactggttcgtgacccagcgcaatttttacgagccacagataattacaacggacaacaccttcgttagcggcaattgtgatgtggtcatcgggatcgtgaacaatactgtatatgaccccctccaacctgagctggaatccttcaaggaggaacttgataaatactttaagaaccatacatcaccagacgtggatttgggagacattagtggcatcaatgccagcgtcgttaacattcagaaggagatagatcgactgaatgaagtggctaaaaacttaaacgagtctctcatcgacctgcaggagcttggtaagtatgaacagtacattaaatggccctggtatatctggctggggttcattgcaggactaatcgccatagtgatggtcaccatcatgctctgctgtatgacttcctgctgttcatgcctgaagggctgttgcagttgtggtagctgctgcaaatttgacgaggatgactccgaacctgtgttgaagggcgttaagctgcactacacatga

SEQ ID NO: 12005 - RNA, 3822 nt, synthetic construct
  misc_feature 1..3822: note = SARS-CoV-2/2019-nCoV/USA-CruiseA-18/2020__MT159716.1 spike protein CDS human (1-1273)
  source 1..3822: mol_type = other RNA
atgttcgtgtttctggtcctccttcccctggttagctcccagtgcgtgaacttgaccacaagaactcaattacctccagcctacactaattctttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgaactgcgtgtgtacagctccgcgaataactgtactttcgagtatgtgtcacaaccttttctgatggacctcgaaggcaagcagggtaatttcaaaaacttaagagagtttgtcttcaagaacattgatgggtactttaaaatctacagtaagcacaccccaataaatctggttagggaccttccccagggattcagcgctttggagcctctggtggatctaccaatcggcattaacatcacacggtttcagactctcctggcccttcatcgctcttatctgaccccgggcgactcctcaagcgggtggacagcaggagccgctgcatactatgtaggttacttgcaacccagaaccttcctcctgaaatataatgaaaacggcacgattactgatgccgtggactgcgctttagatcctctgagtgagacaaagtgtaccctcaagtcttttactgtcgaaaaagggatctaccagacatccaatttcagggtgcagccaaccgagagcatagttcggtttcccaacattacgaatctttgccctttcggagaggtgtttaacgccacccgcttcgcgtcggtctatgcatggaatcgaaagagaatctctaactgtgtggccgactactccgtactgtacaattcagctagtttcagcacatttaaatgctatggcgtttccccaactaagttgaacgacctatgtttcaccaatgtgtacgccgattcttttgtcattaggggtgacgaagtgcggcagatcgcacccgggcaaacaggaaaaatcgctgattataactacaagctgccggacgatttcactggctgcgtcattgcctggaatagcaacaacctcgactcaaaagtgggcgggaattataactacctgtatcgtctttttcgcaagagtaatctgaagcctttcgagagagatatatccaccgaaatctaccaggcgggaagcacaccctgtaacggtgttgagggctttaattgctacttcccattgcagtcttatgggtttcaacctaccaacggagtgggctaccagccctatagggtagtcgtgctctcattcgaactgttacacgccccagcaactgtttgcggtcccaaaaagagtacgaatctggtgaaaaacaagtgtgtcaattttaacttcaatgggctaacaggcaccggagtgctcactgagagcaacaaaaagtttctgcctttccagcagttcggccgggacattgctgataccacagacgccgtacgagatccacaaacccttgagatcttggacataactccgtgctcctttgggggagtgtctgttattacacccggtacgaatacctcgaaccaggtcgctgtgctgtaccaggacgtgaattgtactgaagtccctgttgccatccacgcagatcagctcacaccaacctggcgcgtgtatagcacaggctccaacgtgttccaaactagagccgggtgcctgatcggagctgagcatgtaaacaattcatacgaatgtgacattcccatcggcgcgggtatttgcgcaagttatcagacccagacgaactctcctaggcgggcccgcagcgtcgcttcccagtcaataatcgcctacaccatgagccttggggcagaaaattctgtggcctactccaacaatagtattgctatcccaacaaactttactatcagcgttaccacagaaattctgcccgtgtctatgactaagacctccgtcgattgtacgatgtatatatgcggcgactcaacagagtgtagtaatttgctcctgcaatacggcagcttctgcacccagttaaacagagccctgactggaatcgcagtggagcaggataaaaatacacaggaagtttttgcgcaagtgaagcagatttataaaaccccgcctatcaaggacttcgggggatttaacttctcgcagattctaccagatccctccaaaccttctaagaggagctttatcgaggacctcctgttcaataaggtaactcttgctgatgccggttttataaaacaatacggcgactgtttgggggatatcgcagcccgtgacctgatttgcgctcagaagttcaacggactcaccgtcctgcccccattactgacagatgaaatgatcgcccagtatacgtcagcacttttggctggcaccattacgagtggttggacattcggggccggcgcggccctccagatcccttttgctatgcaaatggcataccggttcaatggaataggcgtgacccagaacgtgctgtatgagaatcagaaactaattgccaaccagtttaactccgctatcgggaagattcaagactctctgagctccacagcctcagcactcggaaaactgcaggacgtcgttaatcagaacgcgcaggcccttaatactttggtgaagcaactgagcagtaacttcggcgctatctcttccgtattaaatgatatactcagccgactggacaaggtggaagccgaggtccagatcgatagacttattaccggtaggctgcagtcgttgcaaacgtacgtgacacagcagctcatccgcgcagctgagattcgggcctcagcaaacctggccgctaccaaaatgtctgaatgcgttctagggcagagtaagagagtggacttttgtggaaaaggctaccacctgatgtccttcccccaaagcgcgccacatggtgtcgtgtttctccacgttacttatgtgccggcccaggagaagaatttcaccacagctcctgcaatctgccacgatggcaaagcccattttcccagggaaggggtcttcgtatctaacggaactcactggtttgtgacccagcgcaatttctacgagccacagataattacaacggacaacacctttgttagcggcaattgtgatgtggtcatcgggatcgtgaacaatactgtatatgaccccctgcaacctgagcttgattccttcaaggaagagttggacaaatacttcaagaaccatacatcaccagatgtggacctgggagatattagtggcatcaatgccagcgtcgttaacattcagaaggaaatagaccgattaaatgaggtggctaaaaacctcaacgaatctctgatcgaccttcaggagctgggtaagtatgagcagtacattaaatggccctggtatatctggctagggtttattgcaggactcatcgccatagtgatggtcaccatcatgctgtgctgtatgacttcctgctgttcatgcttgaagggctgttgcagttgtggtagctgctgcaaattcgatgaagacgattccgagcctgtgctgaagggcgttaagttacactacacatga

SEQ ID NO: 12006 - RNA, 3822 nt, synthetic construct
  misc_feature 1..3822: note SARS-CoV-2/SARS-CoV-2/Yunnan-01/human/2020/CHN__MT049951.1 spike protein CDS human (1-1273)
  source 1..3822: mol_type = other RNA
atgttcgtgtttctggtcctccttcccctggttagctcccagtgcgtgaacttgaccacaagaactcaattacctccagccaatacgaactctttcaccaggggcgtatactatccggacaaggtgtttcggtcaagtgtcctgcacagcacacaggatctattcctcccctttttctccaatgtgacttggtttcatgctatccacgtttctgggaccaacggaacaaaacgcttcgacaatcctgtgctgccatttaacgatggtgtctacttcgcatcgaccgagaagtcaaatattatacgaggctggatctttgggactacacttgacagcaaaacccagagtctgttgattgtgaacaatgccacgaacgtagttatcaaggtgtgtgagttccagttttgcaatgatcccttcctcggagtctattaccataaaaacaataagtcctggatggagtctgagttccgtgtgtatagctccgcgaacaattgtacttttgaatacgtgtcacaacctttcctgatggacctggaaggcaagcagggtaactttaaaaacctcagagagttcgtctttaagaatattgatgggtatttcaaaatctacagtaagcacaccccaataaacttagttagggacctgccccagggatttagcgctcttgagcctttggtggatctgccaatcggcattaatatcacacggttccagactctactcgccctgcatcgctcttaccttaccccgggcgactcctcaagcgggtggacagcaggagccgctgcatattacgtaggttatctgcaacccagaacctttttgctcaaatacaacgaaaatggcacgattactgatgccgtggactgcgctctggatcctttaagtgagacaaagtgtaccctgaagtctttcactgtcgaaaaagggatctatcagacatccaactttagggtgcagccaaccgagagcatagttcggttccccaatattacgaacctctgcccttttggagaggtgttcaatgccacccgcttcgcgtcggtctacgcatggaaccgaaagagaatctctaattgtgtggccgactattccgtactttacaactcagctagttttagcacattcaaatgctacggcgtttccccaactaagctgaatgacttgtgttttaccaacgtgtatgccgattctttcgtcattaggggtgacgaagtgcggcagatcgcacccgggcaaacaggaaaaatcgctgattacaattataagctaccggacgattttactggctgcgtcattgcctggaacagcaacaatctggactcaaaagtgggcgggaactacaattatctctaccgtctgttccgcaagagtaaccttaagccttttgagagagatatatccaccgaaatctatcaggcgggaagcacaccctgtaatggtgttgagggcttcaactgctactttccactgcagtcttacgggttccaacctaccaatggagtgggctatcagccctacagggtagtcgtgttgtcatttgaactcctgcacgccccagcaactgtttgcggtcccaaaaagagtacgaacttagtgaaaaataagtgtgtcaacttcaattttaacgggctgacaggcaccggagtgctaactgagagcaataaaaagttcctccctttccagcagtttggccgggacattgctgataccacagacgccgtacgagatccacaaaccctggagatccttgacataactccgtgctccttcgggggagtgtctgttattacacccggtacgaacacctcgaatcaggtcgctgtgttgtatcaggacgtgaactgtactgaagtccctgttgccatccacgcagatcagctgacaccaacctggcgcgtgtacagcacaggctccaacgtgtttcaaactagagccgggtgcctcatcggagctgagcatgtaaataactcatatgaatgtgacattcccatcggcgcgggtatttgcgcaagttaccagacccagactaattctcctaggcgggcccgcagcgtcgcttcccagtcaataatcgcctataccatgagcctgggggcagagaactctgtggcctactccaataacagtattgctatcccaacaaatttcactatcagcgttaccacagaaattcttcccgtgtctatgactaagacctccgtcgattgtacgatgtacatatgcggcgactcaacagagtgtagtaacctgttgctccaatatggcagcttttgcacccagctgaatagagccttaactggaatcgcagtggagcaggataaaaacacacaggaagttttcgcgcaagtgaagcagatttacaaaaccccgcctatcaaggactttgggggattcaatttttcgcagattctgccagatccctccaaaccttctaagaggagcttcatcgaggacctactctttaacaaggtaactctggctgatgccggtttcataaaacaatatggcgactgtcttggggatatcgcagcccgtgacttgatttgcgctcagaagttcaatggactgaccgtcctgcccccactcttaacagatgaaatgatcgcccagtacacgtcagcactgcttgctggcaccattacgagtggttggacatttggggccggcgcggccttgcagatccctttcgctatgcaaatggcatatcggtttaacggaataggcgtgacccagaatgtgctctacgagaaccagaaactgattgccaaccagttcaattccgctatcgggaagattcaagactctctaagctccacagcctcagcactgggaaaactccaggacgtcgttaaccagaatgcgcaggccctgaacactcttgtgaagcaattgagcagtaattttggcgctatctcttccgtactgaacgatatattaagccgactcgacaaggtggaagccgaggtccagatcgatagactgattaccggtaggcttcagtcgctgcaaacgtatgtgacacagcagttgatccgcgcagctgagattcgggcctcagcaaatctcgccgctaccaaaatgtctgaatgcgttctggggcagagtaagagagtggacttctgtggaaaaggctaccacctaatgtcctttccccaaagcgcgccacatggtgtcgtgttcctgcacgttacttacgtgccggcccaggagaagaactttaccacagctcctgcaatctgccacgatggcaaagcccatttccccagggaaggggtctttgtatctaatggaactcactggttcgtgacccagcgcaacttttatgagccacagataattacaacggacaataccttcgttagcggcaactgtgatgtggtcatcgggatcgtgaataacactgtatacgaccccctccaacctgagctggattccttcaaggaagaacttgacaaatattttaagaatcatacatcaccagatgtggacttgggagatattagtggcatcaacgccagcgtcgttaatattcagaaggaaatagaccgactgaacgaggtggctaaaaacttaaatgaatctctcatcgacctgcaggagcttggtaagtacgagcagtatattaaatggccctggtacatctggctggggttcattgcaggactaatcgccatagtgatggtcaccatcatgctctgctgtatgacttcctgctgttcatgcctgaagggctgttgcagttgtggtagctgctgcaaatttgatgaagacgattccgagcctgtgttgaagggcgttaagctgcactatacatga

SEQ ID NO: 12007 - RNA, 3822 nt, synthetic construct
  misc_feature 1..3822: note = SARS-CoV-2/USA/WA-UW292/2020__EPI_ISL_418077 spike protein CDS human (1-1273)
  source 1..3822: mol_type = other RNA
atgttcgtgtttctggtcctccttcccctggttagctcccagtgcgtgaacttgaccacaagaactcaattacctccagcctacaccaattctttcacgaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgagttccgtgtgtacagctccgcgaataactgtacttttgagtatgtgtcacaacctttcctgatggacctggaaggcaagcagggtaattttaaaaacctcagagagttcgtctttaagaacattgatgggtacttcaaaatctacagtaagcacaccccaataaatttagttagggacctgccccagggatttagcgctcttgagcctttggtggatctgccaatcggcattaacatcacacggttccagactctactcgccctgcatcgctcttatcttaccccgggcgactcctcaagcgggtggacagcaggagccgctgcatactatgtaggttacctgcaacccagaacctttttgctcaaatataatgaaaacggcacgattactgatgccgtggactgcgctctggatcctttaagtgagacaaagtgtaccctgaagtctttcactgtcgaaaaagggatctaccagacatccaattttagggtgcagccaaccgagagcatagttcggttccccaacattacgaatctctgcccttttggagaggtgttcaacgccacccgcttcgcgtcggtctatgcatggaatcgaaagagaatctctaactgtgtggccgactactccgtactttacaattcagctagttttagcacattcaaatgctatggcgtttccccaactaagctgaacgacttgtgttttaccaatgtgtacgccgattctttcgtcattaggggtgacgaagtgcggcagatcgcacccgggcaaacaggaaaaatcgctgattataactacaagctaccggacgattttactggctgcgtcattgcctggaatagcaacaacctggactcaaaagtgggcgggaattataactacctctatcgtctgttccgcaagagtaatcttaagccttttgagagagatatatccaccgaaatctaccaggcgagctctacaccctgtaacggagttgagggtttcaattgctactttccactgcagtcatatggcttccaacctaccaacggggtgggataccagccctatagggtagtcgtgttgagttttgaactcctgcacgccccagcaactgtttgcggccccaaaaagagcacgaatttagtgaaaaacaagtgtgtcaatttcaactttaatggtctgacagggaccggcgtgctaactgagtccaacaaaaagttcctccctttccagcagtttggacgggacattgctgataccacagacgccgtacgagatccacaaaccctggagatccttgacataactccgtgctctttcggcggggtgtcggttattacacccggaacgaataccagcaaccaggtcgctgtgttgtaccaggacgtgaattgtactgaagtccctgttgccatccacgcagatcagctgacaccaacctggcgcgtgtattccacaggttcaaacgtgtttcaaactagagccggctgcctcatcggggctgagcatgtaaacaatagttacgaatgtgacattcccatcggagcgggcatttgcgcatcttatcagacccagacgaacagccctaggcgggcccgctccgtcgcttcacagagcataatcgcctacaccatgtctctgggtgcagaaaattccgtggcctacagtaacaatagcattgctatcccaacaaacttcactatctctgttaccacagaaattcttcccgtgtccatgactaagacctcagtcgattgtacgatgtatatatgcggggacagtacagagtgtagcaatctgttgctccaatacggctcgttttgcacccagctgaacagagccttaactggaatcgcagtggagcaggataaaaatacacaggaagttttcgcgcaagtgaagcagatttataaaaccccgcctatcaaggactttggcgggttcaacttttcccagattctgccagatccctctaaacctagcaagaggtcattcatcgaggacctactctttaataaggtaactctggctgatgccggattcataaaacaatacggtgactgtcttggcgatatcgcagcccgtgacttgatttgcgctcagaagttcaacgggctgaccgtcctccctccactgttaacagatgaaatgatcgcccagtatacgagtgcactgcttgctggaaccattacttccggctggacatttggtgccggggcggccttgcagatccctttcgctatgcaaatggcataccggtttaatggcataggagtgacccagaacgtgctctatgagaatcagaaactgattgccaaccagttcaactctgctatcggcaagattcaagacagcctatcctcaacagccagcgcactggggaaactccaggacgtcgttaatcagaacgcgcaggccctgaatactcttgtgaagcaattgagttctaactttggagctatctccagcgtactgaatgatatattatcgcgactcgacaaggtggaagccgaggtccagatcgatagactgattaccggcaggcttcagtcactgcaaacgtacgtgacacagcagttgatccgcgcagctgagattcgggcctctgcaaacctcgccgctaccaaaatgagtgaatgcgttctgggtcagtccaagagagtggacttctgtgggaaaggataccacctaatgagctttccccaatctgcgccacatggcgtcgtgttcctgcacgttacttatgtgccggcccaggagaagaattttaccacagcacccgctatctgccacgatggtaaagcccatttccccagggaaggcgtctttgtaagcaacgggactcactggttcgtgacccagcgcaatttttacgagccacagataattacaacggacaacaccttcgtttccggaaattgtgatgtggtcatcggcatcgtgaacaatactgtatatgaccccctccaacctgagctggattcattcaaggaagaacttgacaaatactttaagaaccatacaagtccagatgtggacttgggggatattagcggaatcaatgcctctgtcgttaacattcagaaggaaatagaccgactgaatgaggtggctaaaaacttaaacgaatccctcatcgacctgcaggagcttggcaagtatgagcagtacattaaatggccctggtatatctggctgggtttcattgcagggctaatcgccatagtgatggtcaccatcatgctctgctgtatgacttcatgctgtagttgcctgaagggatgttgcagctgtggctcctgctgcaaatttgatgaagacgattctgagcctgtgttgaagggtgttaagctgcactacacatga

SEQ ID NO: 12008 - RNA, 3822 nt, synthetic construct
  misc_feature 1..3822: note = SARS-CoV-2/Iceland/192/2020__EPI_ISL_417819 spike protein CDS human (1-1273)
  source 1..3822: mol_type = other RNA
atgttcgtgtttttcgtcctgctcccccttgttagctcccagtgcgtgaacctgaccacaagaactcaattgcctccagcctacactaattcttttaccaggggcgtatattacccggacaaggtgttccggtcaagtgtcttacacagcacacaggatctgtttctacccttcttttccaacgtgacttggttccatgctatccacgtttctgggaccaatggaacaaaacgctttgacaaccctgtgctcccattcaatgatggtgtctattttgcatcgaccgagaagtcaaacattatacgaggctggatcttcgggactacactggacagcaaaacccagagtcttctgattgtgaataacgccacgaatgtagttatcaaggtgtgtgaatttcagttctgcaacgatcccttcttgggagtctactatcataaaaataacaagtcctggatggagtctgaatttcgtgtgtacagctccgcgaataactgtactttcgagtatgtgtcacaaccttttctcatggacctggaaggcaagcagggtaatttcaaaaacctgagagagtttgtcttcaagaacattgatgggtactttaaaatctacagtaagcacaccccaataaatctcgttagggacttaccccagggattcagcgctctggagcctcttgtggatttgccaatcggcattaacatcacacggtttcagactctgctagccctccatcgctcttatctgaccccgggcgactcctcaagcgggtggacagcaggagccgctgcatactatgtaggttaccttcaacccagaaccttcctgttgaaatataatgaaaacggcacgattactgatgccgtggactgcgctctcgatcctctgagtgagacaaagtgtaccttaaagtcttttactgtcgaaaaagggatctaccagacatccaatttcagggtgcagccaaccgagagcatagttcggtttcccaacattacgaatctgtgccctttcggagaggtgttcaacgccacccgctttgcgtcggtctatgcatggaatcgaaagagaatctctaactgtgtggccgactactccgtactctacaattcagctagtttcagcacatttaaatgctatggcgtttccccaactaaacttaacgacctgtgtttcaccaatgtgtacgccgattcttttgtcattaggggtgacgaagtgcggcagatcgcacccgggcaaacaggaaagatcgctgattataactacaagttgccggacgatttcactggctgcgtcattgcctggaatagcaacaacctagactcaaaagtgggcgggaattataactacctgtatcgtctctttcgcaagagtaatctgaagcctttcgagagagatatatccaccgaaatctaccaggcgggaagcacaccctgtaacggtgttgagggctttaattgctacttcccacttcagtcttatgggtttcaacctaccaacggagtgggctaccagccctatagggtagtcgtgctgtcattcgaattgctccacgccccagcaactgtttgcggtcccaaaaagagtacgaatctggtgaaaaacaagtgtgtcaattttaacttcaatgggttaacaggcaccggagtgctgactgagagcaacaaaaagttcctaccttttcagcagttcggccgggacattgctgataccacagacgccgtacgagatccacaaaccctcgagatcctggacataactccgtgctcctttgggggagtgtctgttattacacccggtacgaatacctcgaaccaggtcgctgtgctttaccagggcgtgaattgtactgaagtccctgttgccatccacgcagaccagttgacaccaacctggcgcgtgtatagcacagggtccaacgtgttccaaactagagccggatgcctgatcggcgctgagcatgtaaacaattcatacgaatgtgatattcccatcggtgcggggatttgcgcaagttatcagacccagacgaactctcctaggcgggcccgcagcgtcgcttcccagtcaataatcgcctacaccatgagcctcggcgcagaaaattctgtggcctactccaacaatagtattgctatcccaacaaactttactatcagcgttaccacagaaattctgcccgtgtctatgactaagacctccgtcgactgtacgatgtatatatgcggagattcaacagagtgtagtaatcttctgttgcaatacggcagcttctgcacccagctcaacagagccctgactgggatcgcagtggagcaggacaaaaatacacaggaagtttttgcgcaagtgaagcagatttataaaaccccgcctatcaaggatttcggaggttttaacttctcgcagattttaccagacccctccaaaccttctaagaggagctttatcgaggatctgctattcaataaggtaactctcgctgacgccggcttcataaaacaatacggggattgtctgggagacatcgcagcccgtgatcttatttgcgctcagaagtttaacggcttgaccgtcctgcccccactcctgacagacgaaatgatcgcccagtatacgtcagcattactggctggtaccattacgagtgggtggacattcggcgccggagcggcccttcagatcccttttgctatgcaaatggcataccggttcaatggcataggggtgacccagaacgtgttgtatgagaatcagaaactcattgccaaccagtttaactccgctatcggaaagattcaagattctctgagctccacagcctcagcactaggcaaactgcaggacgtcgttaatcagaacgcgcaggccctcaatactctggtgaagcaacttagcagtaacttcggtgctatctcttccgtattgaatgacatactgagccgattagataaggtggaagccgaggtccagatcgacagactcattaccgggaggctgcagtcgcttcaaacgtacgtgacacagcagctgatccgcgcagctgagattcgggcctcagcaaacttggccgctaccaaaatgtctgaatgcgttctcggacagagtaagagagtggatttttgtggcaaaggttaccacctgatgtccttcccccaaagcgcgccacatggcgtcgtgtttctacacgttacttatgtgccggcccaggagaagaatttcaccacagctcctgcaatctgccacgacgggaaagcccattttcccagggaaggagtcttcgtatctaacggcactcactggtttgtgacccagcgcaatttctacgagccacagataattacaacggataacaccttcgttagcgggaattgtgacgtggtcatcggaatcgtgaacaatactgtatatgatcccctgcaacctgagctcgactcctttaaggaggagctggataaatacttcaagaaccatacatcaccagacgtggatcttggcgacattagtggtatcaatgccagcgtcgttaacattcagaaggaaatagatcgattgaatgaggtggctaaaaacctgaacgaatctttaatcgacctccaggagctggggaagtatgagcagtacattaaatggccctggtatatctggcttggatttattgcaggcctgatcgccatagtgatggtcaccatcatgctatgctgtatgacttcctgctgttcatgcctcaagggttgttgcagttgtggcagctgctgcaaattcgacgaagatgactccgagcctgtgctgaagggggttaagttgcactacacatga

SEQ ID NO: 12009 - RNA, 3822 nt, synthetic construct
  misc_feature 1..3822: note = SARS-CoV-2/Belgium/ULG-6939/2020__EPI_ISL_417020 spike protein CDS human (1-1273)
  source 1..3822: mol_type = other RNA
atgttcgtgtttctggtcctccttcccctggttagctcccagtgcgtgaacttgaccacaagaactcaattacctccagcctacactaattctttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgagttccgtgtgtacagctccgcgaataactgtacttttgagtatgtgtcacaacctttcctgatggacctggaaggcaagcagggtaattttaaaaacctcagagagttcgtctttaagaacattgatgggtacttcaaaatctacagtaagcacaccccaataaatttagttagggacctgccccagggatttagcgctcttgagcctttggtggatctgccaatcggcattaacatcacacggttccagactctactcgccctgcatcgctcttatcttaccccgggcgactcctcaagcgggtggacagcaggagccgctgcatactatgtaggttacctgcaacccagaacctttttgctcaaatataatgaaaacggcacgattactgatgccgtggactgcgctctggatcctttaagtgagacaaagtgtaccctgaagtctttcactgtcgaaaaagggatctaccagacatccaattttagggtgcagccaaccgagagcatagttcggttccccaacattacgaatctctgcccttttggagaggtgttcaacgccacccgcttcgcgtcggtctatgcatggaatcgaaagagaatctctaactgtgtggccgactactccgtactttacaattcagctagttttagcacattcaaatgctatggcgtttccccaactaagctgaacgacttgtgttttaccaatgtgtacgccgattctttcgtcattaggggtgacgaagtgcggcagatcgcacccgggcaaacaggaaaaatcgctgattataactacaagctaccggacgattttactggctgcgtcattgcctggaatagcaacaacctggactcaaaagtgggcgggaattataactacctctatcgtctgttccgcaagagtaatcttaagccttttgagagagatatatccaccgaaatctaccaggcgggaagcacaccctgtaacggtgttgagggcttcaattgctactttccactgcagtcttatgggttccaacctaccaacggagtgggctaccagccctatagggtagtcgtgttgtcatttgaactcctgcacgccccagcaactgtttgcggtcccaaaaagagtacgaatttagtgaaaaacaagtgtgtcaatttcaactttaatgggctgacaggcaccggagtgctaactgagagcaacaaaaagttcctccctttccagcagtttggccgggacattgctgataccacagacgccgtacgagatccacaaaccctggagatccttgacataactccgtgctccttcgggggagtgtctgttattacacccggtacgaatacctcgaaccaggtcgctgtgttgtaccagggcgtgaattgtactgaagtccctgttgccatccacgcagaccagctgacaccaacctggcgcgtgtatagcacagggtccaacgtgtttcaaactagagccggatgcctcatcggcgctgagcatgtaaacaattcatacgaatgtgatattcccatcggtgcggggatttgcgcaagttatcagacccagacgaactctcctaggcgggcccgcagcgtcgcttcccagtcaataatcgcctacaccatgagcctgggcgcagaaaattctgtggtttactccaacaatagtattgccatcccaacaaacttcactatcagcgtgaccacagaaattcttcccgtctctatgactaagacctccgtggactgtacgatgtatatatgcggagattcaacagagtgtagtaatctgttgctccaatacggcagcttttgcacccagctgaacagagctttaactgggatcgccgttgagcaggacaaaaatacacaggaagtgttcgcacaagtaaagcagatttataaaaccccgcctatcaaggattttggaggtttcaacttttcgcagattctgccagacccctccaaaccttctaagaggagcttcatcgaggatctactctttaataaggtcactctggcggacgctggcttcataaaacaatacggggattgtcttggagacatcgccgcacgtgatttgatttgcgcccagaagttcaacggcctgaccgtgctgcccccactcttaacagacgaaatgatcgctcagtatacgtcagccctgcttgcaggtaccattacgagtgggtggacatttggcgctggagccgcgttgcagatccctttcgccatgcaaatggcttaccggtttaatggcataggggtgacccagaacgtcctctatgagaatcagaaactgattgcaaaccagttcaactccgccatcggaaagattcaagattctctaagctccacagcttcagccctgggcaaactccaggacgttgtgaatcagaacgcacaggcgctgaatactcttgtaaagcaattgagcagtaactttggtgccatctcttccgtgctgaatgacatattaagccgactcgataaggtcgaagctgaggtgcagatcgacagactgattaccgggaggcttcagtcgctgcaaacgtacgttacacagcagttgatccgcgccgcagagattcgggcttcagccaacctcgcagccaccaaaatgtctgaatgcgtgctgggacagagtaagagagtcgatttctgtggcaaaggttaccacctaatgtcctttccccaaagcgctccacatggcgtggttttcctgcacgtgacttatgtcccggcgcaggagaagaattttaccacagcccctgcaatctgccacgacgggaaagctcatttccccagggaaggagtatttgtgtctaacggcactcactggttcgttacccagcgcaatttttacgagccacagataattacaacggataacaccttcgtgagcgggaattgtgacgtcgtgatcggaatcgtaaacaatactgtgtatgatcccctccaacctgagctggactccttcaaggaagaacttgataaatactttaagaaccatacatcaccagacgtcgatttgggcgacattagtggtatcaatgccagcgttgtgaacattcagaaggaaatagatcgactgaatgaggtggccaaaaacttaaacgaatctctcatcgacctgcaggagcttgggaagtatgagcagtacattaaatggccctggtatatctggctgggattcattgctggcctaatcgcaatagtcatggtgaccatcatgctctgctgtatgacttcctgctgttcatgcctgaagggttgttgcagttgtggcagctgctgcaaatttgacgaagatgactccgagcctgttttgaagggggtaaagctgcactacacatga

SEQ ID NO: 12010 - RNA, 3822 nt, synthetic construct
  misc_feature 1..3822: note = SARS-CoV-2/France/HF2496/2020__EPI_ISL_418231 spike protein CDS human (1-1273)
  source 1..3822: mol_type = other RNA
atgttcgtgtttctggtcctccttcccctggttagctcccagtgcgtgaacttgaccacaagaactcaattacctccagcctacactaattctttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgagttccgtgtgtacagctccgcgaataactgtacttttgagtatgtgtcacaacctttcctgatggacctggaaggcaagcagggtaattttaaaaacctcagagagttcgtctttaagaacattgatgggtacttcaaaatctacagtaagcacaccccaataaatttagttagggacctgccccagggatttagcgctcttgagcctttggtggatctgccaatcggcattaacatcacacggttccagactctactcgccctgcatcgctcttatcttaccccgggcgactcctcaagcgggtggacagcaggagccgctgcatactatgtaggttacctgcaacccagaacctttttgctcaaatataatgaaaacggcacgattactgatgccgtggactgcgctctggatcctttaagtgagacaaagtgtaccctgaagtctttcactgtcgaaaaagggatctaccagacatccaattttagggtgcagccaaccgagagcatagttcggttccccaacattacgaatctctgcccttttggagaggtgttcaacgccacccgcttcgcgtcggtctatgcatggaatcgaaagagaatctctaactgtgtggccgactactccgtactttacaattcagctagttttagcacattcaaatgctatggcgtttccccaactaagctgaacgacttgtgttttaccaatgtgtacgccgattctttcgtcattaggggtgacgaagtgcggcagatcgcacccgggcaaacaggaaaaatcgctgattataactacaagctaccggacgattttactggctgcgtcattgcctggaatagcaacaacctggactcaaaagtgggcgggaattataactacctctatcgtctgttccgcaagagtaatcttaagccttttgagagagatatatccaccgaaatctaccaggcgggaagcacaccctgtaacggtgttgagggcttcaattgctactttccactgcagtcttatgggttccaacctaccaacggagtgggctaccagccctatagggtagtcgtgttgtcatttgaactcctgcacgccccagcaactgtttgcggtcccaaaaagagtacgaatttagtgaaaaacaagtgtgtcaatttcaactttaatgggctgacaggcaccggagtgctaactgagagcaacaaaaagttcctccctttccagcagtttggccgggacattgctgataccacagacgccgtacgagatccacaaaccctggagatccttgacataactccgtgctccttcgggggagtgtctgttattacacccggtacgaatacctcgaaccaggtcgctgtgttgtaccagggcgtgaattgtactgaagtccctgttgccatccacgcagaccagctgacaccaacctggcgcgtgtatagcacagggtccaacgtgtttcaaactagagccggatgcctcatcggcgctgagcatgtaaacaattcatacgaatgtgatattcccatcggtgcggggatttgcgcaagttatcagacccagacgaactctcctaggcgggcccgcagcgtcgcttcccagtcaataatcgcctacaccatgagcctgggcgcagaaaattctgtggcctactccaacaatagtattgctatcccaacaaacttcactatcagcgttaccacagaaattcttcccgtgtctatgactaagacctccgtcgactgtacgatgtatatatgcggagattcaacagagtgtagtaatctgttgctccaatacggcagcttttgcacccagctgaacagagccttaactgggatcgcagtggagcaggacaaaaatacacaggaagttttcgcgcaagtgaagcagatttataaaaccccgcctatcaaggattttggaggtttcaacttttcgcagattctgccagacccctccaaaccttctaagaggagcttcatcgaggatctactctttaataaggtaactctggctgacgccggcttcataaaacaatacggggattgtcttggagacatcgtcgcacgtgatttgatttgcgcccagaagttcaacggcctgaccgtgctgcccccactcttaacagacgaaatgatcgctcagtatacgtcagccctgcttgcaggtaccattacgagtgggtggacatttggcgctggagccgcgttgcagatccctttcgccatgcaaatggcttaccggtttaatggcataggggtgacccagaacgtcctctatgagaatcagaaactgattgcaaaccagttcaactccgccatcggaaagattcaagattctctaagctccacagcttcagccctgggcaaactccaggacgttgtgaatcagaacgcacaggcgctgaatactcttgtaaagcaattgagcagtaactttggtgccatctcttccgtgctgaatgacatattaagccgactcgataaggtcgaagctgaggtgcagatcgacagactgattaccgggaggcttcagtcgctgcaaacgtacgttacacagcagttgatccgcgccgcagagattcgggcttcagccaacctcgcagccaccaaaatgtctgaatgcgtgctgggacagagtaagagagtcgatttctgtggcaaaggttaccacctaatgtcctttccccaaagcgctccacatggcgtggttttcctgcacgtgacttatgtcccggcgcaggagaagaattttaccacagcccctgcaatctgccacgacgggaaagctcatttccccagggaaggagtatttgtgtctaacggcactcactggttcgttacccagcgcaatttttacgagccacagataattacaacggataacaccttcgtgagcgggaattgtgacgtcgtgatcggaatcgtaaacaatactgtgtatgatcccctccaacctgagctggactccttcaaggaagaacttgataaatactttaagaaccatacatcaccagacgtcgatttgggcgacattagtggtatcaatgccagcgttgtgaacattcagaaggaaatagatcgactgaatgaggtggccaaaaacttaaacgaatctctcatcgacctgcaggagcttgggaagtatgagcagtacattaaatggccctggtatatctggctgggattcattgctggcctaatcgcaatagtcatggtgaccatcatgctctgctgtatgacttcctgctgttcatgcctgaagggttgttgcagttgtggcagctgctgcaaatttgacgaagatgactccgagcctgttttgaagggggtaaagctgcactacacatga

SEQ ID NO: 12011 - RNA, 3822 nt, synthetic construct
  misc_feature 1..3822: note = SARS-CoV-2/USA/WA-UW291/2020__EPI_ISL_418076 spike protein CDS human (1-1273)
  source 1..3822: mol_type = other RNA
atgttcgtgtttctggtcctccttcccctggttagctcccagtgcgtgaacttgaccacaagaactcaattacctccagcctacactaattctttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgagttccgtgtgtacagctccgcgaataactgtacttttgagtatgtgtcacaacctttcctgatggacctggaaggcaagcagggtaattttaaaaacctcagagagttcgtctttaagaacattgatgggtacttcaaaatctacagtaagcacaccccaataaatttagttagggacctgccccagggatttagcgctcttgagcctttggtggatctgccaatcggcattaacatcacacggttccagactctactcgccctgcatcgctcttatcttaccccgggcgactcctcaagcgggtggacagcaggagccgctgcatactatgtaggttacctgcaacccagaacctttttgctcaaatataatgaaaacggcacgattactgatgccgtggactgcgctctggatcctttaagtgagacaaagtgtaccctgaagtctttcactgtcgaaaaagggatctaccagacatccaattttagggtgcagccaaccgagagcatagttcggttccccaacattacgaatctctgcccttttggagaggtgttcaacgccacccgcttcgcgtcggtctatgcatggaatcgaaagagaatctctaactgtgtggccgactactccgtactttacaattcagctagttttagcacattcaaatgctatggcgtttccccaactaagctgaacgacttgtgttttaccaatgtgtacgccgattctttcgtcattaggggtgacgaagtgcggcagatcgcacccgggcaaacaggaaaaatcgctgattataactacaagctaccggacgattttactggctgcgtcattgcctggaatagcaacaacctggactcaaaagtgggcgggaattataactacctctatcgtctgttccgcaagagtaatcttaagccttttgagagagatatatccaccgaaatctaccaggcgggaagcacaccctgtaacggtgttgagggcttcaattgctactttccactgcagtcttatgggttccaacctaccaacggagtgggctaccagccctatagggtagtcgtgttgtcatttgaactcctgcacgccccagcaactgtttgcggtcccaaaaagagtacgaatttagtgaaaaacaagtgtgtcaatttcaactttaatgggctgacaggcaccggagtgctaactgagagcaacaaaaagttcctccctttccagcagtttggccgggacattgctgataccacagacgccgtacgagatccacaaaccctggagatccttgacataactccgtgctccttcgggggagtgtctgttattacacccggtacgaatacctcgaaccaggtcgctgtgttgtaccagggcgtgaattgtactgaagtccctgttgccatccacgcagaccagctgacaccaacctggcgcgtgtatagcacagggtccaacgtgtttcaaactagagccggatgcctcatcggcgctgagcatgtaaacaattcatacgaatgtgatattcccatcggtgcggggatttgcgcaagttatcagacccagacgaactctcctaggcgggcccgcagcgtcgcttcccagtcaataatcgcctacaccatgagcctgggcgcagaaaattctgtggcctactccaacaatagtattgctatcccaacaaacttcactatcagcgttaccacagaaattcttcccgtgtctatgactaagacctccgtcgactgtacgatgtatatatgcggagattcaacagagtgtagtaatctgttgctccaatacggcagcttttgcacccagctgaacagagccttaactgggatcgcagtggagcaggacaaaaatacacaggaagttttcgcgcaagtgaagcagatttataaaaccccgcctatcaaggattttggaggtttcaacttttcgcagattctgccagacccctccaaaccttctaagaggagcttcatcgaggatctactctttaataaggtaactctggctgacgccggcttcataaaacaatacggggattgtcttggagacatcgcagcccgtgatttgatttgcgctcagaagttcaacggcctgaccgtcctgcccccactcttaacagacgaaatgatcgcccagtatacgtcagcactgcttgctggtaccattacgagtgggtggacatttggcgccggagcggccttgcagatccctttcgctatgcaaatggcataccggtttaatggcataggggtgacccagaacgtgctctatgagaatcagaaactgattgccaaccagttcaactccgctatcggaaagattcaatactctctaagctccacagcctcagcactgggcaaactccaggatgtcgttaatcagaacgcgcaggccctgaatactcttgtgaagcaattgagcagtaactttggtgctatctcttccgtactgaatgacatattaagccgactcgacaaggtggaagccgaggtccagatcgatagactgattaccgggaggcttcagtcgctgcaaacgtacgtgacacagcagttgatccgcgcagctgagattcgggcctcagcaaacctcgccgctaccaaaatgtctgaatgcgttctgggacagagtaagagagtggacttctgtggcaaaggttatcacctaatgtcctttccccaaagcgcgccacatggcgtcgtgttcctgcacgttacttacgtgccggcccaggagaagaattttaccacagctcctgcaatctgccacgatgggaaagcccatttccccagggaaggagtctttgtatctaacggcactcactggttcgtgacccagcgcaatttttatgagccacagataattacaacggacaacaccttcgttagcgggaattgtgatgtggtcatcggaatcgtgaacaatactgtatacgaccccctccaacctgagctggattccttcaaggaagaacttgacaaatattttaagaaccatacatcaccagatgtggacttgggcgatattagtggtatcaatgccagcgtcgttaacattcagaaggaaatagaccgactgaatgaggtggctaaaaacttaaacgaatctctcatcgatctgcaggagcttgggaagtacgagcagtatattaaatggccctggtacatctggctgggattcattgcaggcctaatcgccatagtgatggtcaccatcatgctctgctgtatgacttcctgctgttcatgcctgaagggttgttgcagttgtggcagctgctgcaaatttgacgaagacgattccgagcctgtgttgaagggggttaagctgcactacacatga

SEQ ID NO: 12012 - RNA, 3822 nt, synthetic construct
  misc_feature 1..3822: note = SARS-CoV-2/Portugal/PT0034/2020__EPI_ISL_418019 spike protein CDS human (1-1273)
  source 1..3822: mol_type = other RNA
atgttcgtgtttctggtcctccttcccctggttagctcccagtgcgtgaacttgaccacaagaactcaattacctccagcctacactaattctttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgagttccgtgtgtacagctccgcgaataactgtacttttgagtatgtgtcacaacctttcctgatggacctggaaggcaagcagggtaattttaaaaacctcagagagttcgtctttaagaacattgatgggtacttcaaaatctacagtaagcacaccccaataaatttagttagggacctgccccagggatttagcgctcttgagcctttggtggatctgccaatcggcattaacatcacacggttccagactctactcgccctgcatcgctcttatcttaccccgggcgactcctcaagcgggtggacagcaggagccgctgcatactatgtaggttacctgcaacccagaacctttttgctcaaatataatgaaaacggcacgattactgatgccgtggactgcgctctggatcctttaagtgagacaaagtgtaccctgaagtctttcactgtcgaaaaagggatctaccagacatccaattttagggtgcagccaaccgagagcatagttcggttccccaacattacgaatctctgcccttttggagaggtgttcaacgccacccgcttcgcgtcggtctatgcatggaatcgaaagagaatctctaactgtgtggccgactactccgtactttacaattcagctagttttagcacattcaaatgctatggcgtttccccaactaagctgaacgacttgtgttttaccaatgtgtacgccgattctttcgtcattaggggtgacgaagtgcggcagatcgcacccgggcaaacaggaaaaatcgctgattataactacaagctaccggacgattttactggctgcgtcattgcctggaatagcaacaacctggactcaaaagtgggcgggaattataactacctctatcgtctgttccgcaagagtaatcttaagccttttgagagagatatatccaccgaaatctaccaggcgggaagcacaccctgtaacggtgttgagggcttcaattgctactttccactgcagtcttatgggttccaacctaccaacggagtgggctaccagccctatagggtagtcgtgttgtcatttgaactcctgcacgccccagcaactgtttgcggtcccaaaaagagtacgaatttagtgaaaaacaagtgtgtcaatttcaactttaatgggctgacaggcaccggagtgctaactgagagcaacaaaaagttcctccctttccagcagtttggccgggacattgctgataccacagacgccgtacgagatccacaaaccctggagatccttgacataactccgtgctccttcgggggagtgtctgttattacacccggtacgaatacctcgaaccaggtcgctgtgttgtaccagggcgtgaattgtactgaagtccctgttgccatccacgcagaccagctgacaccaacctggcgcgtgtatagcacagggtccaacgtgtttcaaactagagccggatgcctcatcggcgctgagcatgtaaacaattcatacgaatgtgatattcccatcggtgcggggatttgcgcaagttatcagacccagacgaactctcctaggcgggcccgcagcgtcgcttcccagtcaataatcgcctacaccatgagcctgggcgcagaaaattctgtggcctactccaacaatagtattgctatcccaacaaacttcactatcagcgttaccacagaaattcttcccgtgtctatgactaagacctccgtcgactgtacgatgtatatatgcggagattcaacagagtgtagtaatctgttgctccaatacggcagcttttgcacccagctgaacagagccttaactgggatcgcagtggagcaggacaaaaatacacaggaagttttcgcgcaagtgaagcagatttataaaaccccgcctatcaaggattttggaggtttcaacttttcgcagattctgccagacccctccaaaccttctaagaggagcttcatcgaggatctactctttaataaggtaactctggctgacgccggcttcataaaacaatacggggattgtcttggagacatcgcagcccgtgatttgatttgcgctcagaagttcaacggcctgaccgtcctgcccccactcttaacagacgaaatgatcgcccagtatacgtcagcactgcttgctggtaccattacgagtgggtggacatttggcgccggagcggccttgcagatccctttcgctatgcaaatggcataccggtttaatggcataggggtgacccagaacgtgctctatgagaatcagaaactgattgccaaccagttcaactccgctatcggaaagattcaagattctctaagctccacagcctcagcactgggcaaactccaggacgtcgttaatcagaacgcgcaggccctgaatactcttgtgaagcaattgagcagtaactttggtgctatctcttccgtactgaatgacatattaagccgactcgataaggtggaagccgaggtccagatcgacagactgattaccgggaggcttcagtcgctgcaaacgtacgtgacacagcagttgatccgcgcagctgagattcgggcctcagcaaacctcgccgctaccaaaatgtctgaatgcgttctgggacagagtaagagagtggatttctgtggcaaaggttaccacctaatgtcctttccccaaagcgcgccacatggcgtcgtgttcctgcacgttacttatgtgccggcccaggagaagaattttaccacagctcctgcaatctgccacgacgggaaagcccatttccccagggaaggagtctttgtatctaacggcactcactggttcgtgacccagcgcaatttttacgagccacagataattacaacggataacaccttcgttagcgggaattgtgacgtggtcatcggaatcgtgaacaatactgtatatgatcccctccaacctgagctggactccttcaaggaagaacttgataaatactttaagaaccatacatcaccagacgtggatttgggcgacattagtggtatcaatgccagcgtcgttaacattcagaaggaaatagatcgactgaatgaggtggctaaaaacttaaacgaatctctcatcgacctgcaggagcttgggaagtatgagcagtacattaaatggccctggtatatctggctgggattcattgcaggcctaatcgccatagtgatggtcaccatcatgctctgctgtattacttcctgctgttcatgcctgaagggttgttgcagttgtggcagctgctgcaaatttgacgaagatgactccgagcctgtgttgaagggggttaagctgcactacacatga

SEQ ID NO: 12013 - RNA, 3822 nt, synthetic construct
  misc_feature 1..3822: note = SARS-CoV-2/Iceland/202/2020__EPI_ISL_417750 spike protein CDS human (1-1273)
  source 1..3822: mol_type = other RNA
atgttcgtgtttctggtcctccttcccctggttagctcccagtgcgtgaacttgaccacaagaactcaattacctccagcctacactaattctttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgagttccgtgtgtacagctccgcgaataactgtacttttgaatatgtgtcacaacctttcctgatggacctggaaggcaagcagggtaattttaaaaacctcagagagttcgtctttaagaacattgatgggtacttcaaaatctacagtaagcacaccccaataaatttagttagggacctgccccagggatttagcgctcttgagcctttggtggatctgccaatcggcattaacatcacacggttccagactctactcgccctgcatcgctcttatcttaccccgggcgactcctcaagcgggtggacagcaggagccgctgcatactatgtaggttacctgcaacccagaacctttttgctcaaatataatgaaaacggcacgattactgatgccgtggactgcgctctggatcctttaagtgagacaaagtgtaccctgaagtctttcactgtcgaaaaagggatctaccagacatccaattttagggtgcagccaaccgagagcatagttcggttccccaacattacgaatctctgcccttttggagaggtgttcaacgccacccgcttcgcgtcggtctatgcatggaatcgaaagagaatctctaactgtgtggccgactactccgtactttacaattcagctagttttagcacattcaaatgctatggcgtttccccaactaagctgaacgacttgtgttttaccaatgtgtacgccgattctttcgtcattaggggtgacgaagtgcggcagatcgcacccgggcaaacaggaaaaatcgctgattataactacaagctaccggacgattttactggctgcgtcattgcctggaatagcaacaacctggactcaaaagtgggcgggaattataactacctctatcgtctgttccgcaagagtaatcttaagccttttgagagagatatatccaccgaaatctaccaggcgggaagcacaccctgtaacggtgttgagggcttcaattgctactttccactgcagtcttatgggttccaacctaccaacggagtgggctaccagccctatagggtagtcgtgttgtcatttgaactcctgcacgccccagcaactgtttgcggtcccaaaaagagtacgaatttagtgaaaaacaagtgtgtcaatttcaactttaatgggctgacaggcaccggagtgctaactgagagcaacaaaaagttcctccctttccagcagtttggccgggacattgctgataccacagacgccgtacgagatccacaaaccctggagatccttgacataactccgtgctccttcgggggagtgtctgttattacacccggtacgaatacctcgaaccaggtcgctgtgttgtaccaggacgtgaattgtactgaagtccctgttgccatccacgcagatcagctgacaccaacctggcgcgtgtatagcacaggctccaacgtgtttcaaactagagccgggtgcctcatcggagctgagcatgtaaacaattcatacgaatgtgacattcccatcggcgcgggtatttgcgcaagttatcagacccagacgaactctcctaggcgggcccgcagcgtcgcttcccagtcaataatcgcctacaccatgagcctgggggcagaaaattctgtggcctactccaacaatagtattgctatcccaacaaacttcactatcagcgttaccacagaaattcttcccgtgtctatgactaagacctccgtcgattgtacgatgtatatatgcggcgactcaacagagtgtagtaatctgttgctccaatacggcagcttttgcacccagctgaacagagccttaactggaatcgcagtggagcaggataaaaatacacaggaagttttcgcgcaagtgaagcagatttataaaaccccgcctatcaaggactttgggggattcaacttttcgcagattctgccagatccctccaaaccttctaagaggagcttcatcgaggacctactctttaataaggtaactctggctgatgccggtttcataaaacaatacggcgactgtcttggggatatcgcagcccgtgacttgatttgcgctcagaagttcaacggactgaccgtcctgcccccactcttaacagatgaaatgatcgcccagtatacgtcagcactgcttgctggcaccattacgagtggttggacatttggggccggcgcggccttgcagatccctttcgctatgcaaatggcataccggtttaatggaataggcgtgacccagaacgtgctctatgagaatcagaaactgattgccaaccagttcaactccgctatcgggaagattcaagactctctaagctccacagcctcagcactgggaaaactccaggacgtcgttaatcagaacgcgcaggccctgaatactcttgtgaagcaattgagcagtaactttggcgctatctcttccgtactgaatgatatattaagccgactcgacaaggtggaagccgaggtccagatcgatagactgattaccggtaggcttcagtcgctgcaaacgtacgtgacacagcagttgatccgcgcagctgagattcgggcctcagcaaacctcgccgctaccaaaatgtctgaatgcgttctggggcagagtaagagagtggacttctgtggaaaaggctaccacctaatgtcctttccccaaagcgcgccacatggtgtcgtgttcctgcacgttacttatgtgccggcccaggagaagaattttaccacagctcctgcaatctgccacgatggcaaagcccatttccccagggaaggggtctttgtatctaacggaactcactggttcgtgacccagcgcaatttttacgagccacagataattacaacggacaacaccttcgttagcggcaattgtgatgtggtcatcgggatcgtgaacaatactgtatatgaccccctccaacctgagctggattccttcaaggaggaacttgacaaatactttaagaaccatacatcaccagatgtggacttgggagatattcccggcatcaatgccagtgtcgttaacattcagaaggaaatagaccgactgaatgaggtggctaaaaacttaaacgaaagcctcatcgacctgcaggagcttggtaagtatgagcagtacattaaatggccttggtatatctggctggggttcattgcaggactaatcgccatagtgatggtcaccatcatgctctgctgtatgacttcttgctgttcctgcctgaagggctgttgctcatgtggtagttgctgcaaatttgatgaagacgatagcgagccggtgttgaagggcgttaagctgcactacacatga

SEQ ID NO: 12014 - RNA, 3822 nt, synthetic construct
  misc_feature 1..3822: note = SARS-CoV-2/USA/WA-UW261/2020__EPI_ISL_418046 spike protein CDS human (1-1273)
  source 1..3822: mol_type = other RNA
atgttcgtgtttctggtcctccttcccctggttagctcccagtgcgtgaacttgaccacaagaactcaattacctccagcctacacgaatagcttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgagttccgtgtgtacagctccgcgaataactgtacttttgagtatgtgtcacaacctttcctgatggacctggaaggcaagcagggtaattttaaaaacctcagagagttcgtctttaagaacattgatgggtacttcaaaatctacagtaagcacaccccaataaatttagttagggacctgccccagggatttagcgctcttgagcctttggtggatctgccaatcggcattaacatcacacggttccagactctactcgccctgcatcgctcttatcttaccccgggcgactcctcaagcgggtggacagcaggagccgctgcatactatgtaggttacctgcaacccagaacctttttgctcaaatataatgaaaacggcacgattactgatgccgtggactgcgctctggatcctttaagtgagacaaagtgtaccctgaagtctttcactgtcgaaaaagggatctaccagacatccaattttagggtgcagccaaccgagagcatagttcggttccccaacattacgaatctctgcccttttggagaggtgttcaacgccacccgcttcacatcggtctatgcgtggaatcgaaagagaatctctaactgtgtggcagactactccgtactttacaattcagccagttttagcactttcaaatgctatggcgtttccccaaccaagctgaacgacttgtgttttacaaatgtgtacgctgattctttcgtcattaggggtgacgaagtgcggcagatcgcccccgggcaaactggaaaaatcgcagattataactacaagctaccggacgattttaccggctgcgtcattgcttggaatagcaacaacctggactcaaaagtgggcgggaattataactacctctatcgtctgttccgcaagagtaatcttaagccttttgagagagatatatccacagaaatctaccaggccggaagcaccccctgtaacggtgttgagggcttcaattgctactttccactgcagtcttatgggttccaacctactaacggagtgggctaccagccctatagggtagtcgtgttgtcatttgaactcctgcacgcgccagccacggtttgcggtcccaaaaagagtacaaatttagtgaaaaacaagtgtgtcaatttcaactttaatgggctgaccggcactggagtgctaaccgagagcaacaaaaagttcctccctttccagcagtttggccgggacattgcagatacaaccgacgctgtacgagatccacaaactctggagatccttgacataacaccgtgctccttcgggggagtgtctgttattacgcccggtaccaatacttcgaaccaggtcgccgtgttgtaccaggacgtgaattgtacagaagtccctgttgctatccacgccgatcagctgaccccaacatggcgcgtgtatagcactggctccaacgtgtttcaaaccagagcagggtgcctcatcggagccgagcatgtaaacaattcatacgaatgtgacattcccatcggcgctggtatttgcgcgagttatcagacgcagaccaactctcctaggcgggcacgcagcgtcgcctcccagtcaataatcgcttacacaatgagcctgggggccgaaaattctgtggcatactccaacaatagtattgccatcccaactaacttcaccatcagcgttacaactgaaattcttcccgtgtctatgaccaagacgtccgtcgattgtacaatgtatatatgcggcgactcaaccgagtgtagtaatctgttgctccaatacggatctttttgcactcagctgaacagagctttaacaggcatcgccgtggagcaggataaaaatacccaggaagttttcgcacaagtgaagcagatttataaaactccgcctatcaaggactttgggggattcaacttttcgcagattctgccagatccctccaaaccttctaagaggagcttcatcgaggacctactctttaataaggtaaccctggcggatgctggtttcataaaacaatacggcgactgtcttggggatatcgccgcacgtgacttgatttgcgcccagaagttcaacggactgacagtcctgcccccactcttaacggatgaaatgatcgctcagtatacctcagccctgcttgcaggcactattacaagtggttggacctttggggctggcgccgcgttgcagatccctttcgccatgcaaatggcttaccggtttaatggaataggcgtgacacagaacgtgctctatgagaatcagaaactgattgcaaaccagttcaactccgccatcgggaagattcaagactctctaagctccactgcttcagccctgggaaaactccaggacgtcgttaatcagaacgcacaggcgctgaatacccttgtgaagcaattgagcagtaactttggcgccatctcttccgtactgaatgatatattaagccgactcgacaaggtggaagctgaggtccagatcgatagactgattacgggtaggcttcagtcgctgcaaacatacgtgacccagcagttgatccgcgccgcagagattcgggcttcagccaacctcgcagccactaaaatgtctgaatgcgttctggggcagagtaagagagtggacttctgtggaaaaggctaccacctaatgtcctttccccaaagcgctccacatggtgtcgtgttcctgcacgttacctatgtgccggcgcaggagaagaattttacaactgcccctgcaatctgccacgatggcaaagctcatttccccagggaaggggtctttgtatctaacggaacccactggttcgtgacacagcgcaatttttacgagccacagataattacgaccgacaacactttcgttagcggcaattgtgatgtggtcatcgggatcgtgaacaatacagtatatgaccccctccaacctgagctggattccttcaaggaagaacttgacaaatactttaagaaccatacctcaccagatgtggacttgggagatattagtggcatcaatgccagcgtcgttaacattcagaaggaaatagaccgactgaatgaggtggccaaaaacttaaacgaatctctcatcgacctgcaggagcttggtaagtatgagcagtacattaaatggccctggtatatctggctggggttcattgctggactaatcgcaatagtgatggtcactatcatgctctgctgtatgacatcctgctgttcatgcctgaagggctgttgcagttgtggtagctgctgcaaatttgatgaagacgattccgagcctgtgttgaagggcgttaagctgcactacacctga

SEQ ID NO: 12015 - RNA, 3822 nt, synthetic construct
  misc_feature 1..3822: note = SARS-CoV-2/Portugal/PT0035/2020__EPI_ISL_418020 spike protein CDS human (1-1273)
  source 1..3822: mol_type = other RNA
atgttcgtgtttctggtcctccttcccctggttagctcccagtgcgtgaacttgaccacaagaactcaattacctccagcctacacgaatagcttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgagttccgtgtgtacagctccgcgaataactgtacttttgagtatgtgtcacaacctttcctgatggacctggaaggcaagcagggtaattttaaaaacctcagagagttcgtctttaagaacattgatgggtacttcaaaatctacagtaagcacaccccaataaatttagttagggacctgccccagggatttagcgctcttgagcctttggtggatctgccaatcggcattaacatcacacggttccagactctactcgccctgcatcgctcttatcttaccccgggcgactcctcaagcgggtggacagcaggagccgctgcatactatgtaggttacctgcaacccagaacctttttgctcaaatataatgaaaacggcacgattactgatgccgtggactgcgctctggatcctttaagtgagacaaagtgtaccctgaagtctttcactgtcgaaaaagggatctaccagacatccaattttagggtgcagccaaccgagagcatagttcggttccccaacattacgaatctctgcccttttggagaggtgttcaacgccacccgcttcgcgtcggtctatgcatggaatcgaaagagaatctctaactgtgtggccgactactccgtactttacaattcagctagttttagcacattcaaatgctatggcgtttccccaactaagctgaacgacttgtgttttaccaatgtgtacgccgattctttcgtcattaggggtgacgaagtgcggcagatcgcacccgggcaaacaggaaaaatcgctgattataactacaagctaccggacgattttactggctgcgtcattgcctggaatagcaacaacctggactcaaaagtgggcgggaattataactacctctatcgtctgttccgcaagagtaatcttaagccttttgagagagatatatccaccgaaatctaccaggcgggaagcacaccctgtaacggtgttgagggcttcaattgctactttccactgcagtcttatgggttccaacctaccaacggagtgggctaccagccctatagggtagtcgtgttgtcatttgaactcctgcacgccccagcaactgtttgcggtcccaaaaagagtacgaatttagtgaaaaacaagtgtgtcaatttcaactttaatgggctgacaggcaccggagtgctaactgagagcaacaaaaagttcctccctttccagcagtttggccgggacattgctgataccacagacgccgtacgagatccacaaaccctggagatccttgacataactccgtgctccttcgggggagtgtctgttattacacccggtacgaatacctcgaaccaggtcgctgtgttgtaccaggacgtgaattgtactgaagtccctgttgccatccacgcagatcagctgacaccaacctggcgcgtgtatagcacaggctccaacgtgtttcaaactagagccgggtgcctcatcggagctgagcatgtaaacaattcatacgaatgtgacattcccatcggcgcgggtatttgcgcaagttatcagacccagacgaactctcctaggcgggcccgcagcgtcgcttcccagtcaataatcgcctacaccatgagcctgggggcagaaaattctgtggcctactccaacaatagtattgctatcccaacaaacttcactatcagcgttaccacagaaattcttcccgtgtctatgactaagacctccgtcgattgtacgatgtatatatgcggcgactcaacagagtgtagtaatctgttgctccaatacggatctttttgcacccagctgaacagagccttaactggcatcgcagtggagcaggataaaaatacacaggaagttttcgcgcaagtgaagcagatttataaaaccccgcctatcaaggactttgggggattcaacttttcgcagattctgccagatccctccaaaccttctaagaggagcttcatcgaggacctactctttaataaggtaactctggctgatgccggtttcataaaacaatacggcgactgtcttggggatatctcagcacgtgacttgatttgcgcccagaagttcaacggactgaccgtcctgcccccactcttaacagatgaaatgatcgctcagtatacgagtgccctgcttgcaggcaccattacttccggttggacatttggggctggcgccgcgttgcagatccctttcgccatgcaaatggcttaccggtttaatggaataggcgtgacccagaacgtgctctatgagaatcagaaactgattgcaaaccagttcaactctgccatcgggaagattcaagacagcctatcctcaacagctagcgccctgggaaaactccaggacgtcgttaatcagaacgcacaggcgctgaatactcttgtgaagcaattgagttctaactttggcgccatctccagcgtactgaatgatatattatcgcgactcgacaaggtggaagctgaggtccagatcgatagactgattaccggtaggcttcagtcactgcaaacgtacgtgacacagcagttgatccgcgccgcagagattcgggcttctgccaacctcgcagccaccaaaatgagtgaatgcgttctggggcagtccaagagagtggacttctgtggaaaaggctaccacctaatgagctttccccaatctgctccacatggtgtcgtgttcctgcacgttacttatgtgccggcgcaggagaagaattttaccacagcccctgcaatctgccacgatggcaaagctcatttccccagggaaggggtctttgtaagcaacggaactcactggttcgtgacccagcgcaatttttacgagccacagataattacaacggacaacaccttcgtttccggcaattgtgatgtggtcatcgggatcgtgaacaatactgtatatgaccccctccaacctgagctggattcattcaaggaagaacttgacaaatactttaagaaccatacaagtccagatgtggacttgggagatattagcggcatcaatgcctctgtcgttaacattcagaaggaaatagaccgactgaatgaggtggccaaaaacttaaacgaatccctcatcgacctgcaggagcttggtaagtatgagcagtacattaaatggccctggtatatctggctggggttcattgctggactaatcgcaatagtgatggtcaccatcatgctctgctgtatgacttcatgctgtagttgcctgaagggctgttgcagctgtggttcctgctgcaaatttgatgaagacgattctgagcctgtgttgaagggcgttaagctgcactacacatga

SEQ ID NO: 12016 - RNA, 3822 nt, synthetic construct
  misc_feature 1..3822: note = SARS-CoV-2/USA/NY-NYUMC7/2020__EPI_ISL_418192 spike protein CDS human (1-1273)
  source 1..3822: mol_type = other RNA
atgttcgtgtttctggtcctccttcccctggttagctcccagtgcgtgaacttgaccacaagaactcaattacctccagcctacactaattctttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctaccatcacaaaaataacaagtcctggatggagtctgagttccgtgtgtatagctccgcgaataactgtacttttgagtacgtgtcacaacctttcctgatggacctggaaggcaagcagggtaattttaaaaacctcagagagttcgtctttaagaacattgatgggtatttcaaaatctacagtaagcataccccaataaatttagttagggacctgccccagggatttagcgctcttgagcctttggtggatctgccaatcggcattaacatcacacggttccagactctactcgccctgcaccgctcttaccttaccccgggcgactcctcaagcgggtggacagcaggagccgctgcatattacgtaggttatctgcaacccagaacctttttgctcaaatacaatgaaaacggcacgattactgatgccgtggactgcgctctggatcctttaagtgagacaaagtgtaccctgaagtctttcactgtcgaaaaagggatctatcagacatccaattttagggtgcagccaaccgagagcatagttcggttccccaacattacgaatctctgcccttttggagaggtgttcaacgccacccgcttcgcgtcggtctacgcatggaatcgaaagagaatctctaactgtgtggccgactattccgtactttacaattcagctagttttagcacattcaaatgctacggcgtttccccaactaagctgaacgacttgtgttttaccaatgtgtatgccgattctttcgtcattaggggtgacgaagtgcggcagatcgcacccgggcaaacaggaaaaatcgctgattacaactataagctaccggacgattttactggctgcgtcattgcctggaatagcaacaacctggactcaaaagtgggcgggaattacaactatctctaccgtctgttccgcaagagtaatcttaagccttttgagagagatatatccaccgaaatctatcaggcgggaagcacaccctgtaacggtgttgagggcttcaattgctactttccactgcagtcttacgggttccaacctaccaacggagtgggctatcagccctacagggtagtcgtgttgtcatttgaactcctgcacgccccagcaactgtttgcggtcccaaaaagagtacgaatttagtgaaaaacaagtgtgtcaatttcaactttaatgggctgacaggcaccggagtgctaactgagagcaacaaaaagttcctccctttccagcagtttggccgggacattgctgataccacagacgccgtacgagatccacaaaccctggagatccttgacataactccgtgctccttcgggggagtgtctgttattacacccggtacgaatacctcgaaccaggtcgctgtgttgtatcagggcgtgaattgtactgaagtccctgttgccatccatgcagaccagctgacaccaacctggcgcgtgtacagcacagggtccaacgtgtttcaaactagagccggatgcctcatcggcgctgagcacgtaaacaattcatatgaatgtgatattcccatcggtgcggggatttgcgcaagttaccagacccagacgaactctcctaggcgggcccgcagcgtcgcttcccagtcaataatcgcctataccatgagcctgggcgcagaaaattctgtggcctactccaacaatagtattgctatcccaacaaacttcactatcagcgttaccacagaaattcttcccgtgtctatgactaagacctccgtcgactgtacgatgtacatatgcggagattcaacagagtgtagtaatctgttgctccaatatggcagcttttgcacccagctgaacagagccttaactgggatcgcagtggagcaggacaaaaatacacaggaagttttcgcgcaagtgaagcagatttacaaaaccccgcctatcaaggattttggaggtttcaacttttcgcagattctgccagacccctccaaaccttctaagaggagcttcatcgaggatctactctttaataaggtaactctggctgacgccggcttcataaaacaatatggggattgtcttggagacatcgcagcccgtgatttgatttgcgctcagaagttcaacggcctgaccgtcctgcccccactcttaacagacgaaatgatcgcccagtacacgtcagcactgcttgctggtaccattacgagtgggtggacatttggcgccggagcggccttgcagatccctttcgctatgcaaatggcatatcggtttaatggcataggggtgacccagaacgtgctctacgagaatcagaaactgattgccaaccagttcaactccgctatcggaaagattcaagattctctaagctccacagcctcagcactgggcaaactccaggacgtcgttaatcagaacgcgcaggccctgaatactcttgtgaagcaattgagcagtaactttggtgctatctcttccgtactgaatgacatattaagccgactcgataaggtggaagccgaggtccagatcgacagactgattaccgggaggcttcagtcgctgcaaacgtatgtgacacagcagttgatccgcgcagctgagattcgggcctcagcaaacctcgccgctaccaaaatgtctgaatgcgttctgggacagagtaagagagtggatttctgtggcaaaggttaccatctaatgtcctttccccaaagcgcgccacacggcgtcgtgttcctgcacgttacttacgtgccggcccaggagaagaattttaccacagctcctgcaatctgccatgacgggaaagcccacttccccagggaaggagtctttgtatctaacggcactcattggttcgtgacccagcgcaatttttatgagccacagataattacaacggataacaccttcgttagcgggaattgtgacgtggtcatcggaatcgtgaacaatactgtatacgatcccctccaacctgagctggactccttcaaggaagaacttgataaatattttaagaaccacacatcaccagacgtggatttgggcgacattagtggtatcaatgccagcgtcgttaacattcagaaggaaatagatcgactgaatgaggtggctaaaaacttaaacgaatctctcatcgacctgcaggagcttgggaagtacgagcagtatattaaatggccctggtacatctggctgggattcattgcaggcctaatcgccatagtgatggtcaccatcatgctctgctgtatgacttcctgctgttcatgcctgaagggttgttgcagttgtggcagctgctgcaaatttgacgaagatgactccgagcctgtgttgaagggggttaagctgcattatacatga

SEQ ID NO: 12017 - RNA, 3822 nt, synthetic construct
  misc_feature 1..3822: note = SARS-CoV-2/Iceland/189/2020__EPI_ISL_417709 spike protein CDS human (1-1273)
  source 1..3822: mol_type = other RNA
atgttcgtgtttctggtcctccttcccctggttagctcccagtgcgtgaacttgaccacaagaactcaattacctccagcctacaccaattctttcacgaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgagttccgtgtgtacagctccgcgaataactgtacttttgagtatgtgtcacaacctttcctgatggacctggaaggcaagcagggtaattttaaaaacctcagagagttcgtctttaagaacattgatgggtacttcaaaatctacagtaagcacaccccaataaatttagttagggacctgccccagggatttagcgctcttgagcctttggtggatctgccaatcggcattaacatcacacggttccagactctactcgccctgcatcgctcttatcttaccccgggcgactcctcaagcgggtggacagcaggagccgctgcatactatgtaggttacctgcaacccagaacctttttgctcaaatataatgaaaacggcacgattactgatgccgtggactgcgctctggatcctttaagtgagacaaagtgtaccctgaagtctttcactgtcgaaaaagggatctaccagacatccaattttagggtgcagccaaccgagagcatagttcggttccccaacattacgaatctctgcccttttggagaggtgttcaacgccacccgcttcgcgtcggtctatgcatggaatcgaaagagaatctctaactgtgtggccgactactccgtactttacaattcagctagttttagcacattcaaatgctatggcgtttccccaactaagctgaacgacttgtgttttaccaatgtgtacgccgattctttcgtcattaggggtgacgaagtgcggcagatcgcacccgggcaaacaggaaaaatcgctgattataactacaagctaccggacgattttactggctgcgtcattgcctggaatagcaacaacctggactcaaaagtgggcgggaattataactacctctatcgtctgttccgcaagagtaatcttaagccttttgagagagatatatccaccgaaatctaccaggcgggaagcacaccctgtaacggtgttgagggcttcaattgctactttccactgcagtcttatgggttccaacctaccaacggagtgggctaccagccctatagggtagtcgtgttgtcatttgaactcctgcacgccccagcaactgtttgcggtcccaaaaagagtacgaatttagtgaaaaacaagtgtgtcaatttcaactttaatgggctgacaggcaccggagtgctaactgagagcaacaaaaagttcctccctttccagcagtttggccgggacattgctgataccacagacgccgtacgagatccacaaaccctggagatccttgacataactccgtgctccttcgggggagtgtctgttattacacccggtacgaatacctcgaaccaggtcgctgtgttgtaccagggcgtgaattgtactgaagtccctgttgccatccacgcagaccagctgacaccaacctggcgcgtgtatagcacagggtccaacgtgtttcaaactagagccggatgcctcatcggcgctgagcatgtaaacaattcatacgaatgtgatattcccatcggtgcggggatttgcgcaagttatcagacccagacgaactctcctaggcgggcccgcagcgtcgcttcccagtcaataatcgcctacaccatgagcctgggcgcagaaaattctgtggcctactccaacaatagtattgctatcccaacaaacttcactatcagcgttaccacagaaattcttcccgtgtctatgactaagacctccgtcgactgtacgatgtatatatgcggagattcaacagagtgtagtaatctgttgctccaatacggcagcttttgcacccagctgaacagagccttaactgggatcgcagtggagcaggacaaaaatacacaggaagttttcgcgcaagtgaagcagatttataaaaccccgcctatcaaggattttggaggtttcaacttttcgcagattctgccagacccctccaaaccttctaagaggagcttcatcgaggatctactctttaataaggtaactctggctgacgccggcttcaccaaacaatacggggattgtcttggagacatagcagcccgtgatttgatctgcgctcagaagttcaacggcctgacagtcctccctccactgttaacggacgaaatgattgcccagtatacctcagcactgcttgctggtactatcacaagtgggtggacctttggcgccggagcggccttgcagattcctttcgctatgcaaatggcataccggtttaatggcatcggggtgacacagaacgtgctctatgagaatcagaaactgatagccaaccagttcaactccgctattggaaagatccaagattctctaagctccactgcctcagcactgggcaaactccaggacgtcgttaatcagaacgcgcaggccctgaatacccttgtgaagcaattgagcagtaactttggtgctatttcttccgtactgaatgacatcttaagccgactcgataaggtggaagccgaggtccagatagacagactgatcacggggaggcttcagtcgctgcaaacatacgtgacccagcagttgattcgcgcagctgagatccgggcctcagcaaacctcgccgctactaaaatgtctgaatgcgttctgggacagagtaagagagtggatttctgtggcaaaggttaccacctaatgtcctttccccaaagcgcgccacatggcgtcgtgttcctgcacgttacctatgtgccggcccaggagaagaattttacaactgcacccgctatttgccacgacgggaaagcccatttccccagggaaggagtctttgtatctaacggcacccactggttcgtgacacagcgcaatttttacgagccacagatcataacgaccgataacactttcgttagcgggaattgtgacgtggtcattggaatcgtgaacaatacagtatatgatcccctccaacctgagctggactccttcaaggaagaacttgataaatactttaagaaccatacctcaccagacgtggatttgggcgacatcagtggtattaatgccagcgtcgttaacatccagaaggaaattgatcgactgaatgaggtggctaaaaacttaaacgaatctctcatagacctgcaggagcttgggaagtatgagcagtacatcaaatggccctggtatatttggctgggattcatcgcaggcctaattgccatcgtgatggtcactataatgctctgctgtatgacatcctgctgttcatgcctgaagggttgttgcagttgtggcagctgctgcaaatttgacgaagatgactccgagcctgtgttgaagggggttaagctgcactacacctga

SEQ ID NO: 12018 - RNA, 3822 nt, synthetic construct
  misc_feature 1..3822: note = SARS-CoV-2/Australia/NSW56/2020__EPI_ISL_417408 spike protein CDS human (1-1273)
  source 1..3822: mol_type = other RNA
atgttcgtgtttctggtcctccttcccctggttagctcccagtgcgtgaacttgaccacaagaactcaattacctccagcctacacgaatagcttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgagttccgtgtgtacagctccgcgaataactgtacttttgagtatgtgtcacaacctttcctgatggacctggaaggcaagcagggtaattttaaaaacctcagagagttcgtctttaagaacattgatgggtacttcaaaatctacagtaagcacaccccaataaatttagttagggacctgccccagggatttagcgctcttgagcctttggtggatctgccaatcggcattaacatcacacggttccagactctactcgccctgcatcgctcttatcttaccccgggcgactcctcaagcgggtggacagcaggagccgctgcatactatgtaggttacctgcaacccagaacctttttgctcaaatataatgaaaacggcacgattactgatgccgtggactgcgctctggatcctttaagtgagacaaagtgtaccctgaagtctttcactgtcgaaaaagggatctaccagacatccaattttagggtgcagccaaccgagagcatagttcggttccccaacattacgaatctctgcccttttggagaggtgttcaacgccacccgcttcgcgtcggtctatgcatggaatcgaaagagaatctctaactgtgtggccgactactccgtactttacaattcagctagttttagcacattcaaatgctatggcgtttccccaactaagctgaacgacttgtgttttaccaatgtgtacgccgattctttcgtcattaggggtgacgaagtgcggcagatcgcacccgggcaaacaggaaaaatcgctgattataactacaagctaccggacgattttactggctgcgtcattgcctggaatagcaacaacctggactcaaaagtgggcgggaattataactacctctatcgtctgttccgcaagagtaatcttaagccttttgagagagatatatccaccgaaatctaccaggcgggaagcacaccctgtaacggtgttgagggcttcaattgctactttccactgcagtcttatgggttccaacctaccaacggagtgggctaccagccctatagggtagtcgtgttgtcatttgaactcctgcacgccccagcaactgtttgcggtcccaaaaagagtacgaatttagtgaaaaacaagtgtgtcaatttcaactttaatgggctgacaggcaccggagtgctaactgagagcaacaaaaagttcctccctttccagcagtttggccgggacattgctgataccacagacgccgtacgagatccacaaaccctggagatccttgacataactccgtgctccttcgggggagtgtctgttattacacccggtacgaatacctcgaaccaggtcgctgtgttgtaccaggacgtgaattgtactgaagtccctgttgccatccacgcagatcagctgacaccaacctggcgcgtgtatagcacaggctccaacgtgtttcaaactagagccgggtgcctcatcggagctgagcatgtaaacaattcatacgaatgtgacattcccatcggcgcgggtatttgcgcaagttatcagacccagacgaactctcctaggcgggcccgcagcgtcgcttcccagtcaataatcgcctacaccatgagcctgggggcagaaaattctgtggcctactccaacaatagtattgctatcccaacaaacttcactatcagcgttaccacagaaattcttcccgtgtctatgactaagacctccgtcgattgtacgatgtatatatgcggcgactcaacagagtgtagtaatctgttgctccaatacggatctttttgcacccagctgaacagagccttaactggcatcgcagtggagcaggataaaaatacacaggaagttttcgcgcaagtgaagcagatttataaaaccccgcctatcaaggactttgggggattcaacttttcgcagattctgccagattcctctaaacccagcaagaggtcattcatcgaggacctactctttaataaggtaactctggctgatgccggtttcataaaacaatacggcgactgtcttggggatatcgcagcccgtgacttgatttgcgctcagaagttcaacggactgaccgtcctccctcccctgttaacagatgaaatgatcgcccagtatacgagtgcactgcttgctggcaccattacttccggttggacatttggggccggcgcggccttgcagatcccattcgctatgcaaatggcataccggtttaatggaataggcgtgacccagaacgtgctctatgagaatcagaaactgattgccaaccagttcaactctgctatcgggaagattcaagacagcctatcctcaacagccagcgcactgggaaaactccaggacgtcgttaatcagaacgcgcaggccctgaatactcttgtgaagcaattgagttctaactttggcgctatctccagcgtactgaatgatatattatcgcgactcgacaaggtggaagccgaggtccagatcgatagactgattaccggtaggcttcagtcactgcaaacgtacgtgacacagcagttgatccgcgcagctgagattcgggcctctgcaaacctcgccgctaccaaaatgagtgaatgcgttctggggcagtccaagagagtggacttctgtggaaaaggctaccacctaatgagctttcctcaatctgcgccccatggtgtcgtgttcctgcacgttacttatgtgccagcccaggagaagaattttaccacagcaccggctatctgccacgatggcaaagcccatttccctagggaaggggtctttgtaagcaacggaactcactggttcgtgacccagcgcaatttttacgagccccagataattacaacggacaacaccttcgtttccggcaattgtgatgtggtcatcgggatcgtgaacaatactgtatatgacccactccaacccgagctggattcattcaaggaagaacttgacaaatactttaagaaccatacaagtcctgatgtggacttgggagatattagcggcatcaatgcctctgtcgttaacattcagaaggaaatagaccgactgaatgaggtggctaaaaacttaaacgaatccctcatcgacctgcaggagcttggtaagtatgagcagtacattaaatggccatggtatatctggctggggttcattgcaggactaatcgccatagtgatggtcaccatcatgctctgctgtatgacttcatgctgtagttgcctgaagggctgttgcagctgtggttcctgctgcaaatttgatgaagacgattctgagcccgtgttgaagggcgttaagctgcactacacatga

SEQ ID NO: 12019 - RNA, 3822 nt, synthetic construct
  misc_feature 1..3822: note = SARS-CoV-2/Iceland/280/2020__EPI_ISL_417608 spike protein CDS human (1-1273)
  source 1..3822: mol_type = other RNA
atgttcgtgtttctggtcctccttcccctggttagctcccagtgcgtgaacttgaccacaagaactcaattacctccagcctacactaattctttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgagttccgtgtgtacagctccgcgaataactgtacttttgagtatgtgtcacaacctttcctgatggacctggaaggcaagcagggtaattttaaaaacctcagagagttcgtctttaagaacattgatgggtacttcaaaatctacagtaagcacaccccaataaatttagttagggacctgccccagggatttagcgctcttgagcctttggtggatctgccaatcggcattaacatcacacggttccagactctactcgccctgcatcgctcttatcttaccccgggcgactcctcaagcgggtggacagcaggagccgctgcatactatgtaggttacctgcaacccagaacctttttgctcaaatataatgaaaacggcacgattactgatgccgtggactgcgctctggatcctttaagtgagacaaagtgtaccctgaagtctttcactgtcgaaaaagggatctaccagacatccaattttagggtgcagccaaccgagagcatagttcggttccccaacattacgaatctctgcccttttggagaggtgttcaacgccacccgcttcgcgtcggtctatgcatggaatcgaaagagaatctctaactgtgtggccgactactccgtactttacaattcagctagttttagcacattcaaatgctatggcgtttccccaactaagctgaacgacttgtgttttaccaatgtgtacgccgattctttcgtcattaggggtgacgaagtgcggcagatcgcacccgggcaaacaggaaaaatcgctgattataactacaagctaccggacgattttactggctgcgtcattgcctggaatagcaacaacctggactcaaaagtgggcgggaattataactacctctatcgtctgttccgcaagagtaatcttaagccttttgagagagatatatccaccgaaatctaccaggcgggaagcacaccctgtaacggtgttgagggcttcaattgctactttccactgcagtcttatgggttccaacctaccaacggagtgggctaccagccctatagggtagtcgtgttgtcatttgaactcctgcacgccccagcaactgtttgcggtcccaaaaagagtacgaatttagtgaaaaacaagtgtgtcaatttcaactttaatgggctgacaggcaccggagtgctaactgagagcaacaaaaagttcctccctttccagcagtttggccgggacattgctgataccacagacgccgtacgagatccacaaaccctggagatccttgacataactccgtgctccttcgggggagtgtctgttattacacccggtacgaatacctcgaaccaggtcgctgtgttgtaccagggcgtgaattgtactgaagtccctgttgccatccacgcagaccagctgacaccaacctggcgcgtgtatagcacagggtccaacgtgtttcaaactagagccggatgcctcatcggcgctgagcatgtaaacaattcatacgaatgtgatattcccatcggtgcggggatttgcgcaagttatcacacccagacgaactctcctaggcgggcccgcagcgtcgcttcccagtcaataatcgcctacaccatgagcctgggcgcagaaaattctgtggcctactccaacaatagtattgctatcccaacaaacttcactatcagcgttaccacagaaattcttcccgtgtctatgactaagacctccgtcgactgtacgatgtatatatgcggagattcaacagagtgtagtaatctgttgctccagtacggcagcttttgcacccaactgaacagagccttaactgggatcgcagtggagcaggacaaaaatacacaggaagttttcgcacaggtgaagcaaatttataaaaccccgcctatcaaggattttggaggtttcaacttttcgcagattctgccagacccctccaaaccttctaagaggagcttcatcgaggatctactctttaataaggtaactctggctgacgccggcttcataaaacagtacggggattgtcttggagacatcgcagcccgtgatttgatttgcgctcaaaagttcaacggcctgaccgtcctgcccccactcttaacagacgaaatgatcgcccagtatacgtcagcactgcttgctggtaccattacgagtgggtggacatttggcgccggagcggccttgcagatccctttcgctatgcagatggcataccggtttaatggcataggggtgacccaaaacgtgctctatgagaatcagaaactgattgccaaccagttcaactccgctatcggaaagattcaggattctctaagctccacagcctcagcactgggcaaactccaagacgtcgttaatcagaacgcgcaggccctgaatactcttgtgaagcagttgagcagtaactttggtgctatctcttccgtactgaatgacatattaagccgactcgataaggtggaagccgaggtccaaatcgacagactgattaccgggaggcttcagtcgctgcagacgtacgtgacacaacagttgatccgcgcagctgagattcgggcctcagcaaacctcgccgctaccaaaatgtctgaatgcgttctgggacagagtaagagagtggatttctgtggcaaaggttaccatctaatgtcctttccccagagcgcgccacacggcgtcgtgttcctgcacgttacttatgtgccggcccaagagaagaattttaccacagcgcctgctatctgccatgacgggaaagcccacttccccagggaaggagtctttgtatctaacggcactcattggttcgtgacccagcgcaatttttacgagccacagataattacaacggataacaccttcgttagcgggaattgtgacgtggtcatcggaatcgtgaacaatactgtatatgatcccctccagcctgagctggactccttcaaggaagaacttgataaatactttaagaaccacacatcaccagacgtggatttgggcgacattagtggtatcaatgccagcgtcgttaacattcaaaaggaaatagatcgactgaatgaggtggctaaaaacttaaacgaatctctcatcgacctgcaggagcttgggaagtatgagcagtacattaaatggccctggtatatctggctgggattcattgcaggcctaatcgccatagtgatggtcaccatcatgctctgctgtatgacttcctgctgttcatgcctgaagggttgttgcagttgtggcagctgctgcaaatttgacgaagatgactccgagcctgtgttgaagggggttaagctgcattacacatga

SEQ ID NO: 12020 - RNA, 3822 nt, synthetic construct
  misc_feature 1..3822: note = SARS-CoV-2/Iceland/247/2020__EPI_ISL_417575 spike protein CDS human (1-1273)
  source 1..3822: mol_type = other RNA
atgttcgtgtttctggtcctccttcccctggttagctcccagtgcgtgaacttgaccacaagaactcaattacctccagcctacactaattctttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgagttccgtgtgtacagctccgcgaataactgtacttttgagtatgtgtcacaacctttcctgatggacctggaaggcaagcagggtaattttaaaaacctcagagagttcgtctttaagaacattgatgggtacttcaaaatctacagtaagcacaccccaataaatttagttagggacctgccccagggatttagcgctcttgagcctttggtggatctgccaatcggcattaacatcacacggttccagactctactcgccctgcatcgctcttatcttaccccgggcgactcctcaagcgggtggacagcaggagccgctgcatactatgtaggttacctgcaacccagaacctttttgctcaaatataatgaaaacggcacgattactgatgccgtggactgcgctctggatcctttaagtgagacaaagtgtaccctgaagtctttcactgtcgaaaaagggatctaccagacatccaattttagggtgcagccaaccgagagcatagttcggttccccaacattacgaatctctgcccttttggagaggtgttcaacgccacccgcttcgcgtcggtctatgcatggaatcgaaagagaatctctaactgtgtggccgactactccgtactttacaattcagctagttttagcacattcaaatgctatggcgtttccccaactaagctgaacgacttgtgttttaccaatgtgtacgccgattctttcgtcattaggggtgacgaagtgcggcagatcgcacccgggcaaacaggaaaaatcgctgattataactacaagctaccggacgattttactggctgcgtcattgcctggaatagcaacaacctggactcaaaagtgggcgggaattataactacctctatcgtctgttccgcaagagtaatcttaagccttttgagagagatatatccaccgaaatctaccaggcgggaagcacaccctgtaacggtgttgagggcttcaattgctactttccactgcagtcttatgggttccaacctaccaacggagtgggctaccagccctatagggtagtcgtgttgtcatttgaactcctgcacgccccagcaactgtttgcggtcccaaaaagagtacgaatttagtgaaaaacaagtgtgtcaatttcaactttaatgggctgacaggcaccggagtgctaactgagagcaacaaaaagttcctccctttccagcagtttggccgggacattgctgataccacagacgccgtacgagatccacaaaccctggagatccttgacataactccgtgctccttcgggggagtgtctgttattacacccggtacgaatacctcgaaccaggtcgctgtgttgtaccagggcgtgaattgtactgaagtccctgttgccatccacgcagaccagctgacaccaacctggcgcgtgtatagcacagggtccaacgtgtttcaaactagagccggatgcctcatcggcgctgagcatgtaaacaattcatacgaatgtgatattcccatcggtgcggggatttgcgcaagttatcagacccagacgaactctcctaggcgggcccgcagcgtcgcttcccagtcaataatcgcctacaccatgagcctgggcgcagaaaattctgtggcctactccaacaatagtattgctatcccaacaaacttcactatcagcgttaccacagaaattcttcccgtgtctatgactaagacctccgtcgactgtacgatgtatatatgcggagattcaacagagtgtagtaatctgttgctccaatacggcagcttttgcacccagctgaacagagccttaactgggatcgcagtggagcaggacaaaaatacacaggaagttttcgcgcaagtgaagcagatttataaaaccccgcctatcaaggattttggaggtttcaacttttcgcagattctgccagacccctccaaaccttctaagaggagcttcatcgaggatctactctttaataaggtaactctggctgacgccggcttcataaaacaatacggggattgtcttggagacatcgcagcccgtgatttgatttgcgctcagaagttcaacggcctgaccgtcctgcccccactcttaacagacgaaatgatcgcccagtatacgtcagcactgcttgctggtaccattacgagtgggtggacatttggcgccggagcggccttgcagatccctttcgctatgcaaatggcataccggtttaatggcataggggtgacccagaacgtgctctatgagaatcagaaactgattgccaaccagttcaactccgctatcggaaagattcaagattctctaagctccacagcctcagcactgggcaaactccaggacgtcgttaatcagaacgcgcaggccctgaatactcttgtgaagcaattgagcagtaactttggtgctatctcttccgtactgaatgacatattaagccgactcgataaggtggaagccgaggtccagatcgacagactgattaccgggaggcttcagtcgctgcaaacgtacgtgacacagcagttgatccgcgcagctgagattcgggcctcagcaaacctcgccgctaccaaaatgtctgaatgcgttctgggacagagtaagagagtggatttctgtggcaaaggttaccacctaatgtcctttccccaaagcgcgccacatggcgtcgtgttcctgcacgttacttatgtgccggcccaggagaagaattttaccacagctcctgcaatctgccacgacgggaaagcccatttccccagggaaggagtctttgtatctaacggcactcactggttcgtgacccagcgcaatttttacgagccacagataattacaacggataacaccttcgttagcgggaattgtgacgtggtcatcggaatcgtgaacaatactgtatatgatcccctccaacctgagctggactccttcaaggaagaacttgataaatactttaagaaccatacatcaccagacgtggatttgggcgacattagtggtatcaatgccagcgtcgttaacattcagaaggaaatagatcgactgaatgaggtggctaaaaacttaaacgaatctctcatcgacctgcaggagcttgggaagtatgagcagtacattaaatggccctggtatatctggctgggattcattgcaggcctaatcgccatagtgatcgtcaccattatgctctgctgtatgacttcctgctgttcatgcctgaagggttgttgcagttgtggcagctgctgcaaatttgacgaagatgactccgagcctgtgttgaagggggttaagctgcactacacatga

SEQ ID NO: 12021 - RNA, 3822 nt, synthetic construct
  misc_feature 1..3822: note = SARS-CoV-2/Iceland/238/2020__EPI_ISL_417566 spike protein CDS human (1-1273)
  source 1..3822: mol_type = other RNA
atgttcgtgtttctggtcctccttcccctggttagctcccagtgcgtgaacttgaccacaagaactcaattacctccagcctacactaattctttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgagttccgtgtgtacagctccgcgaataactgtacttttgagtatgtgtcacaacctttcctgatggacctggaaggcaagcagggtaattttaaaaacctcagagagttcgtctttaagaacattgatgggtacttcaaaatctacagtaagcacaccccaataaatttagttagggacctgccccagggatttagcgctcttgagcctttggtggatctgccaatcggcattaacatcacacggttccagactctactcgccctgcatcgctcttatcttaccccgggcgactcctcaagcgggtggacagcaggagccgctgcatactatgtaggttacctgcaacccagaacctttttgctcaaatataatgaaaacggcacgattactgatgccgtggactgcgctctggatcctttaagtgagacaaagtgtaccctgaagtctttcactgtcgaaaaagggatctaccagacatccaattttagggtgcagccaaccgagagcatagttcggttccccaacattacgaatctctgcccttttggagaggtgttcaacgccacccgcttcgcgtcggtctatgcatggaatcgaaagagaatctctaactgtgtggccgactactccgtactttacaattcagctagttttagcacattcaaatgctatggcgtttccccaactaagctgaacgacttgtgttttaccaatgtgtacgccgattctttcgtcattaggggtgacgaagtgcggcagatcgcacccgggcaaacaggaaaaatcgctgattataactacaagctaccggacgattttactggctgcgtcattgcctggaatagcaacaacctggactcaaaagtgggcgggaattataactacctctatcgtctgttccgcaagagtaatcttaagccttttgagagagatatatccaccgaaatctaccaggcgggaagcacaccctgtaacggtgttgagggcttcaattgctactttccactgcagtcttatgggttccaacctaccaacggagtgggctaccagccctatagggtagtcgtgttgtcatttgaactcctgcacgccccagcaactgtttgcggtcccaaaaagagtacgaatttagtgaaaaacaagtgtgtcaatttcaactttaatgggctgacaggcaccggagtgctaactgagagcaacaaaaagttcctccctttccagcagtttggccgggacattgctgataccacagacgccgtacgagatccacaaaccctggagatccttgacataactccgtgctccttcgggggagtgtctgttattacacccggtacgaatacctcgaaccaggtcgctgtgttgtaccagggcgtgaattgtactgaagtccctgttgccatccacgcagaccagctgacaccaacctggcgcgtgtatagcacagggtccaacgtgtttcaaactagagccggatgcctcatcggcgctgagcatgtaaacaattcatacgaatgtgatattcccatcggtgcggggatttgcgcaagttatcagacccagacgaactctcctaggcgggcccgcagcgtcgcttcccagtcaataatcgcctacaccatgagcctgggcgcagaaaattctgtggcctactccaacaatagtattgctatcccaacaaacttcactatcagcgttaccacagaaattcttcccgtgtctatgactaagacctccgtcgactgtacgatgtatatatgcggagattcaacagagtgtagtaatctgttgctccaatacggcagcttttgcacccagctgaacagagccttaactgggatcgcagtggagcaggacaaaaatacacaggaagttttcgcgcaagtgaagcagatttataaaaccccgcctatcaaggattttggaggtttcaacttttcgcagattctgccagacccctccaaaccttctaagaggagcttcatcgaggatctactctttaataaggtaactctggctgacgtcggcttcataaaacaatacggggattgtcttggagacatcgccgcacgtgatttgatttgcgcccagaagttcaacggcctgaccgtgctgcccccactcttaacagacgaaatgatcgctcagtatacgtcagccctgcttgcaggtaccattacgagtgggtggacatttggcgctggagccgcgttgcagatccctttcgccatgcaaatggcttaccggtttaatggcataggggtgacccagaacgtcctctatgagaatcagaaactgattgcaaaccagttcaactccgccatcggaaagattcaagattctctaagctccacagcttcagccctgggcaaactccaggacgttgtgaatcagaacgcacaggcgctgaatactcttgtaaagcaattgagcagtaactttggtgccatctcttccgtgctgaatgacatattaagccgactcgataaggtcgaagctgaggtgcagatcgacagactgattaccgggaggcttcagtcgctgcaaacgtacgttacacagcagttgatccgcgccgcagagattcgggcttcagccaacctcgcagccaccaaaatgtctgaatgcgtgctgggacagagtaagagagtcgatttctgtggcaaaggttaccacctaatgtcctttccccaaagcgctccacatggcgtggttttcctgcacgtgacttatgtcccggcgcaggagaagaattttaccacagcccctgcaatctgccacgacgggaaagctcatttccccagggaaggagtatttgtgtctaacggcactcactggttcgttacccagcgcaatttttacgagccacagataattacaacggataacaccttcgtgagcgggaattgtgacgtcgtgatcggaatcgtaaacaatactgtgtatgatcccctccaacctgagctggactccttcaaggaagaacttgataaatactttaagaaccatacatcaccagacgtcgatttgggcgacattagtggtatcaatgccagcgttgtgaacattcagaaggaaatagatcgactgaatgaggtggccaaaaacttaaacgaatctctcatcgacctgcaggagcttgggaagtatgagcagtacattaaatggccctggtatatctggctgggattcattgctggcctaatcgcaatagtcatggtgaccatcatgctctgctgtatgacttcctgctgttcatgcctgaagggttgttgcagttgtggcagctgctgcaaatttgacgaagatgactccgagcctgttttgaagggggtaaagctgcactacacatga

SEQ ID NO: 12022 - RNA, 3822 nt, synthetic construct
  misc_feature 1..3822: note = SARS-CoV-2/Greece/16/2020__EPI_ISL_418265 spike protein CDS human (1-1273)
  source 1..3822: mol_type = other RNA
atgttcgtgtttctggtcctccttcccctggttagctcccagtgcgtgaacttgaccacaagaactcaattacctccagcctacactaattctttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgagttccgtgtgtacagctccgcgaataactgtacttttgaatatgtgtcacaacctttcctgatggacctggaaggcaagcagggtaattttaaaaacctcagagagttcgtctttaagaacgttgatgggtacttcaaaatttacagtaagcacaccccaatcaatttagtgagggacctgccccagggatttagcgctcttgagcctttggtagatctgccaataggcatcaacattacacggttccagactctactcgccctgcatcgctcttatcttaccccgggcgactcctcaagcgggtggacagcaggagccgctgcatactatgtgggttacctgcaacccagaacctttttgctcaaatataatgaaaacggcacgatcactgatgccgtcgactgcgctctggatcctttaagtgagacaaagtgtaccctgaagtctttcactgtggaaaaagggatttaccagacatccaattttagggttcagccaaccgagagcatcgtgcggttccccaacataacgaatctctgcccttttggagaggtcttcaacgccacccgcttcgcgtcggtgtatgcatggaatcgaaagagaatttctaactgtgtagccgactactccgttctttacaattcagctagttttagcacattcaaatgctatggcgtgtccccaactaagctgaacgacttgtgttttaccaatgtctacgccgattctttcgtgatcaggggtgacgaagtccggcagattgcacccgggcaaacaggaaaaatcgctgattataactacaagctaccggacgattttactggctgcgtgatcgcctggaatagcaacaacctggactcaaaagttggcgggaattataactacctctatcgtctgttccgcaagagtaatcttaagccttttgagagagatatttccaccgaaatataccaggcgggaagcacaccctgtaacggtgtggagggcttcaattgctactttccactgcagtcttatgggttccaacctaccaacggagtaggctaccagccctatagggtcgtggttttgtcatttgaactcctgcacgccccagcaactgtgtgcggtcccaaaaagagtacgaatttagtcaaaaacaagtgtgtgaatttcaactttaatgggctgacaggcaccggagtactaactgagagcaacaaaaagttcctccctttccagcagtttggccgggacatcgctgataccacagacgccgtgcgagatccacaaaccctggagattcttgacatcactccgtgctccttcgggggagtttctgtcataacacccggtacgaatacctcgaaccaggtggctgtgttgtaccaggacgtcaattgtactgaagttcctgtggccattcacgcagatcagctgacaccaacctggcgcgtgtatagcacaggctccaacgtatttcaaactagagccgggtgcctcatcggagctgagcatgtcaacaattcatacgaatgtgacatccccattggcgcgggtatctgcgcaagttatcagacccagacgaactctcctaggcgggcccgcagcgtggcttcccagtcaattatagcctacaccatgagcctgggggcagaaaattctgttgcctactccaacaatagtatcgctattccaacaaacttcactatcagcgtgaccacagaaatccttcccgtctctatgactaagacctccgtggattgtacgatgtatatttgcggcgactcaacagagtgtagtaatctgttgctccaatacggcagcttttgcacccagctgaacagagccttaactggaatagcagttgagcaggataaaaatacacaggaagtgttcgcgcaagtaaagcagatctataaaaccccgcctattaaggactttgggggattcaacttttcgcagatcctgccagatccctccaaaccttctaagaggagcttcattgaggacctactctttaataaggtcactctggctgatgccggtttcatcaaacaatacggcgactgtcttggggatatagcagcccgtgacttgatctgcgctcagaagttcaacggactgaccgtgctgcccccactcttaacagatgaaatgattgcccagtatacgtcagcactgcttgctggcaccatcacgagtggttggacatttggggccggcgcggccttgcagattcctttcgctatgcaaatggcataccggtttaatggaatcggcgtgacccagaacgtcctctatgagaatcagaaactgatagccaaccagttcaactccgctattgggaagatccaagactctctaagctccacagcctcagcactgggaaaactccaggacgttgtgaatcagaacgcgcaggccctgaatactcttgtaaagcaattgagcagtaactttggcgctatttcttccgtgctgaatgatatcttaagccgactcgacaaggtcgaagccgaggtgcagatagatagactgatcaccggtaggcttcagtcgctgcaaacgtacgttacacagcagttgattcgcgcagctgagatccgggcctcagcaaacctcgccgctaccaaaatgtctgaatgcgtgctggggcagagtaagagagtcgacttctgtggaaaaggctaccacctaatgtcctttccccaaagcgcgccacatggtgtggttttcctgcacgtgacttatgtcccggcccaggagaagaattttaccacagctcctgcaatttgccacgatggcaaagcccatttccccagggaaggggtatttgtgtctaacggaactcactggttcgttacccagcgcaatttttacgagccacagatcataacaacggacaacaccttcgtgagcggcaattgtgatgtcgtgattgggatcgtaaacaatactgtgtatgaccccctccaacctgagctggattccttcaaggaggaacttgacaaatactttaagaaccatacatcaccagatgtcgacttgggagatatcagtggcattaatgccagcgttgtgaacatccagaaggaaattgaccgactgaatgaggtggctaaaaacttaaacgaatctctcatagacctgcaggagcttggtaagtatgagcagtacatcaaatggccctggtatatttggctggggttcatcgcaggactaattgccatcgtcatggtgaccataatgctctgctgtatgacttcctgctgttcatgcctgaagggctgttgcagttgtggtagctgctgcaaatttgatgaagacgattccgagcctgttttgaagggcgtaaagctgcactacacatga

SEQ ID NO: 12023 - RNA, 3822 nt, synthetic construct
  misc_feature 1..3822: note = SARS-CoV-2/Iceland/319/2020__EPI_ISL_417648 spike protein CDS human (1-1273)
  source 1..3822: mol_type = other RNA
atgttcgtgtttctggtcctccttcccctggttagctcccagtgcgtgaacttgaccacaagaactcaattacctccagcctacactaattctttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgagttccgtgtgtacagctccgcgaataactgtacttttgagtatgtgtcacaacctttcctgattgacctggaaggcaagcagggtaattttaaaaacctcagagagttcgtctttaagaacatcgatgggtacttcaaaatatacagtaagcacaccccaatcaatttagttagggacctgccccagggatttagcgctcttgagcctttggtggatctgccaattggcatcaacattacacggttccagactctactcgccctgcatcgctcttatcttaccccgggcgactcctcaagcgggtggacagcaggagccgctgcatactatgtaggttacctgcaacccagaacctttttgctcaaatataatgaaaacggcacgatcactgatgccgtggactgcgctctggatcctttaagtgagacaaagtgtaccctgaagtctttcactgtcgaaaaagggatataccagacatccaattttagggtgcagccaaccgagagcattgttcggttccccaacatcacgaatctctgcccttttggagaggtgttcaacgccacccgcttcgcgtcggtctatgcatggaatcgaaagagaatttctaactgtgtggccgactactccgtactttacaattcagctagttttagcacattcaaatgctatggcgtttccccaactaagctgaacgacttgtgttttaccaatgtgtacgccgattctttcgtcatcaggggtgacgaagtgcggcagatcgcacccgggcaaacaggaaaaattgctgattataactacaagctaccggacgattttactggctgcgtcatagcctggaatagcaacaacctggactcaaaagtgggcgggaattataactacctctatcgtctgttccgcaagagtaatcttaagccttttgagagagatatctccaccgaaatttaccaggcgggaagcacaccctgtaacggtgttgagggcttcaattgctactttccactgcagtcttatgggttccaacctaccaacggagtgggctaccagccctatagggtagtcgtgttgtcatttgaactcctgcacgccccagcaactgtttgcggtcccaaaaagagtacgaatttagtgaaaaacaagtgtgtcaatttcaactttaatgggctgacaggcaccggagtgctaactgagagcaacaaaaagttcctccctttccagcagtttggccgggacatcgctgataccacagacgccgtacgagatccacaaaccctggagatacttgacattactccgtgctccttcgggggagtgtctgttatcacacccggtacgaatacctcgaaccaggtcgctgtgttgtaccagggcgtgaattgtactgaagtccctgttgccatccacgcagaccagctgacaccaacctggcgcgtgtatagcacagggtccaacgtgtttcaaactagagccggatgcctcattggcgctgagcatgtaaacaattcatacgaatgtgatatccccattggtgcggggatatgcgcaagttatcagacccagacgaactctcctaggcgggcccgcagcgtcgcttcccagtcaatcattgcctacaccatgagcctgggcgcagaaaattctgtggcctactccaacaatagtatcgctatcccaacaaacttcactattagcgttaccacagaaatacttcccgtgtctatgactaagacctccgtcgactgtacgatgtatatctgcggagattcaacagagtgtagtaatctgttgctccaatacggcagcttttgcacccagctgaacagagccttaactgggattgcagtggagcaggacaaaaatacacaggaagttttcgcgcaagtgaagcagatctataaaaccccgcctattaaggattttggaggtttcaacttttcgcagatcctgccagacccctccaaaccttctaagaggagcttcatagaggatctactctttaataaggtaactctggctgacgccggcttcatcaaacaatacggggattgtcttggagacattgcagcccgtgatttgatctgcgctcagaagttcaacggcctgaccgtcctgcccccactcttaacagacgaaatgattgcccagtatacgtcagcactgcttgctggtaccatcacgagtgggtggacatttggcgccggagcggccttgcagatacctttcgctatgcaaatggcataccggtttaatggcattggggtgacccagaacgtgctctatgagaatcagaaactgatcgccaaccagttcaactccgctattggaaagatccaagattctctaagctccacagcctcagcactgggcaaactccaggacgtcgttaatcagaacgcgcaggccctgaatactcttgtgaagcaattgagcagtaactttggtgctatatcttccgtactgaatgacatcttaagccgactcgataaggtggaagccgaggtccagattgacagactgatcaccgggaggcttcagtcgctgcaaacgtacgtgacacagcagttgattcgcgcagctgagatccgggcctcagcaaacctcgccgctaccaaaatgtctgaatgcgttctgggacagagtaagagagtggatttctgtggcaaaggttaccacctaatgtcctttccccaaagcgcgccacatggcgtcgtgttcctgcacgttacttatgtgccggcccaggagaagaattttaccacagctcctgcaatatgccacgacgggaaagcccatttccccagggaaggagtctttgtatctaacggcactcactggttcgtgacccagcgcaatttttacgagccacagattatcacaacggataacaccttcgttagcgggaattgtgacgtggtcatcggaattgtgaacaatactgtatatgatcccctccaacctgagctggactccttcaaggaagaacttgataaatactttaagaaccatacatcaccagacgtggatttgggcgacatcagtggtattaatgccagcgtcgttaacatacagaaggaaatcgatcgactgaatgaggtggctaaaaacttaaacgaatctctcattgacctgcaggagcttgggaagtatgagcagtacatcaaatggccctggtatatttggctgggattcatcgcaggcctaatagccatcgtgatggtcaccattatgctctgctgtatgacttcctgctgttcatgcctgaagggttgttgcagttgtggcagctgctgcaaatttgacgaagatgactccgagcctgtgttgaagggggttaagctgcactacacatga

SEQ ID NO: 12024 - RNA, 3822 nt, synthetic construct
  misc_feature 1..3822: note = SARS-CoV-2/Congo/94/2020__EPI_ISL_417947 spike protein CDS human (1-1273)
  source 1..3822: mol_type = other RNA
atgttcgtgtttctggtcctccttcccctggttagctcccagtgcgtgaacttgaccacaagaactcaattacctccagcctacactaattctttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgagttccgtgtgtacagctccgcgaataactgtacttttgagtatgtgtcacaacctttcctgatggacctggaaggcaagcagggtaattttaaaaacctcagagagttcgtctttaagaacattgatgggtacttcaaaatctacagtaagcacaccccaataaatttagttagggacctgccccagggatttagcgctcttgagcctttggtggatctgccaatcggcattaacatcacacggttccagactctactcgccctgcatcgctcttatcttaccccgggcgactcctcaagcgggtggacagcaggagccgctgcatactatgtaggttacctgcaacccagaacctttttgctcaaatataatgaaaacggcacgattactgatgccgtggactgcgctctggatcctttaagtgagacaaagtgtaccctgaagtctttcactgtcgaaaaagggatctaccagacatccaattttagggtgcagccaaccgagagcatagttcggttccccaacattacgaatctctgcccttttggagaggtgttcaacgccacccgcttcgcgtcggtctatgcatggaatcgaaagagaatctctaactgtgtggccgactactccgtactttacaattcagctagttttagcacattcaaatgctatggcgtttccccaactaagctgaacgacttgtgttttaccaatgtgtacgccgattctttcgtcattaggggtgacgaagtgcggcagatcgcacccgggcaaacaggaaaaatcgctgattataactacaagctaccggacgattttactggctgcgtcattgcctggaatagcaacaacctggactcaaaagtgggcgggaattataactacctctatcgtctgttccgcaagagtaatcttaagccttttgagagagatatatccaccgaaatctaccaggcgggaagcacaccctgtaacggtgttgagggcttcaattgctactttccactgcagtcttatgggttccaacctaccaacggagtgggctaccagccctatagggtagtcgtgttgtcatttgaactcctgcacgccccagcaactgtttgcggtcccaaaaagagtacgaatttagtgaaaaacaagtgtgtcaatttcaactttaatgggctgacaggcaccggagtgctaactgagagcaacaaaaagttcctccctttccagcagtttggccgggacattgctgataccacagacgccgtacgagatccacaaaccctggagatccttgacataactccgtgctccttcgggggagtgtctgttattacacccggtacgaatacctcgaaccaggtcgctgtgttgtaccagggcgtgaattgtactgaagtccctgttgccatccacgcagaccagctgacaccaacctggcgcgtgtatagcacagggtccaacgtgtttcaaactagagccggatgcctcatcggcgctgagcatgtaaacaattcatacgaatgtgatattcccatcggtgcggggatttgcgcaagttatcagacccagacgaactctcctaggcgggcccgcagcgtcgcttcccagtcaataatcgcctacaccatgagcctgggcgcagaaaattctgtggcctactccaacaatagtattgctatcccaacaaacttcactatcagcgttaccacagaaattcttcccgtgtctatgactaagacctccgtcgactgtacgatgtatatatgcggagattcaacagagtgtagtaatctgttgctccaatacggcagcttttgcacccagctgaacagagccttaactgggatcgcagtggagcaggacaaaaatacacaggaagttttcgcgcaagtgaagcagatttataaaaccccgcctatcaaggattttggaggtttcaacttttcgcagattctgccagacccctccaaaccttctaagaggagcttcatcgaggatatactatttaataaggtaactctcgctgacgccggcttcatcaaacaatacggggattgtctgggagacattgcagcccgtgatcttatctgcgctcagaagttcaacggcttgaccgtcctgcccccactcctgacagacgaaatgattgcccagtatacgtcagcattactggctggtaccatcacgagtgggtggacatttggcgccggagcggcccttcagatacctttcgctatgcaaatggcataccggtttaatggcattggggtgacccagaacgtgttgtatgagaatcagaaactcatcgccaaccagttcaactccgctattggaaagatccaagattctctgagctccacagcctcagcactaggcaaactgcaggacgtcgttaatcagaacgcgcaggccctcaatactctggtgaagcaacttagcagtaactttggtgctatatcttccgtattgaatgacatcctgagccgattagataaggtggaagccgaggtccagattgacagactcatcaccgggaggctgcagtcgcttcaaacgtacgtgacacagcagctgattcgcgcagctgagatccgggcctcagcaaacttggccgctaccaaaatgtctgaatgcgttctcggacagagtaagagagtggatttctgtggcaaaggttaccacctgatgtcctttccccaaagcgcgccacatggcgtcgtgttcctacacgttacttatgtgccggcccaggagaagaattttaccacagctcctgcaatatgccacgacgggaaagcccatttccccagggaaggagtctttgtatctaacggcactcactggttcgtgacccagcgcaatttttacgagccacagattatcacaacggataacaccttcgttagcgggaattgtgacgtggtcatcggaattgtgaacaatactgtatatgatcccctgcaacctgagctcgactccttcaaggaagaactggataaatactttaagaaccatacatcaccagacgtggatcttggcgacatcagtggtattaatgccagcgtcgttaacatacagaaggaaatcgatcgattgaatgaggtggctaaaaacctgaacgaatctttaattgacctccaggagctggggaagtatgagcagtacatcaaatggccctggtatatttggcttggattcatcgcaggcctgatagccatcgtgatggtcaccattatgctatgctgtatgacttcctgctgttcatgcctcaagggttgttgcagttgtggcagctgctgcaaatttgacgaagatgactccgagcctgtgctgaagggggttaagttgcactacacatga

SEQ ID NO: 12025 - RNA, 3822 nt, synthetic construct
  misc_feature 1..3822: note = SARS-CoV-2/Congo/158/2020__EPI_ISL_417950 spike protein CDS human (1-1273)
  source 1..3822: mol_type = other RNA
atgttcgtgtttctggtcctccttcccctggttagctcccagtgcgtgaacttgaccacaagaactcaattacctccagcctacactaattctttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgagttccgtgtgtacagctccgcgaataactgtacttttgaatatgtgtcacaacctttcctgatggacctggaaggcaagcagggtaattttaaaaacctcagagagttcgtctttaagaacattgatgggtacttcaaaatctacagtaagcacaccccaataaatttagttagggacctgccccagggatttagcgctcttgagcctttggtggatctgccaatcggcattaacatcacacggttccagactctactcgccctgcatcgctcttatcttaccccgggcgactcctcaagcgggtggacagcaggagccgctgcatactatgtaggttacctgcaacccagaacctttttgctcaaatataatgaaaacggcacgattactgatgccgtggactgcgctctggatcctttaagtgagacaaagtgtaccctgaagtctttcactgtcgaaaaagggatctaccagacatccaattttagggtgcagccaaccgagagcatagttcggttccccaacattacgaatctctgcccttttggagaggtgttcaacgccacccgcttcgcgtcggtctatgcatggaatcgaaagagaatctctaactgtgtggccgactactccgtactttacaattcagctagttttagcacattcaaatgctatggcgtttccccaactaagctgaacgacttgtgttttaccaatgtgtacgccgattctttcgtcattaggggtgacgaagtgcggcagatcgcacccgggcaaacaggaaaaatcgctgattataactacaagctaccggacgattttactggctgcgtcattgcctggaatagcaacaacctggactcaaaagtgggcgggaattataactacctctatcgtctgttccgcaagagtaatcttaagccttttgagagagatatatccaccgaaatctaccaggcgggaagcacaccctgtaacggtgttgagggcttcaattgctactttccactgcagtcttatgggttccaacctaccaacggagtgggctaccagccctatagggtagtcgtgttgtcatttgaactcctgcacgccccagcaactgtttgcggtcccaaaaagagtacgaatttagtgaaaaacaagtgtgtcaatttcaactttaatgggctgacaggcaccggagtgctaactgagagcaacaaaaagttcctccctttccagcagtttggccgggacattgctgataccacagacgccgtacgagatccacaaaccctggagatccttgacataactccgtgctccttcgggggagtgtctgttattacacccggtacgaatacctcgaaccaggtcgctgtgttgtaccaggacgtgaattgtactgaagtccctgttgccatccacgcagatcagctgacaccaacctggcgcgtgtatagcacaggctccaacgtgtttcaaactagagccgggtgcctcatcggagctgagcatgtaaacaattcatacgaatgtgacattcccatcggcgcgggtatttgcgcaagttatcagacccagacgaactctcctaggcgggcccgcagcgtcgcttcccagtcaataatcgcctacaccatgagcctgggggcagaaaattctgtggcctactccaacaatagtattgctatcccaacaaacttcactatcagcgttaccacagaaattcttcccgtgtctatgactaagacctccgtcgattgtacgatgtatatatgcggcgactcaacagagtgtagtaatctgttgctccaatacggcagcttttgcacccagctgaacagagccttaactggaatcgcagtggagcaggataaaaatacacaggaagttttcgcgcaagtgaagcagatttataaaaccccgcctatcaaggactttgggggattcaacttttcgcagattctgccagatccctccaaaccttctaagaggagcttcatcgaggacctactctttaataaggtaactctggctgatgccggtttcataaaacaatacggcgactgtcttggggatatcgcagcccgtgacttgatttgcgctcagaagttcaacggactgaccgtcctgcccccactcttaacagatgaaatgatcgcccagtatacgtcagcactgcttgctggcaccattacgagtggttggacatttggggccggcgcggccttgcagatccctttcgctatgcaaatggcataccggtttaatggaataggcgtgacccagaacgtgctctatgagaatcagaaactgattgccaaccagttcaactccgctatcgggaagattcaagactctctaagctccacagcctcagcactgggaaaactccaggacgtcgttaatcagaacgcgcaggccctgaatactcttgtgaagcaattgagcagtaactttggcgctatctcttccgtactgaatgatatattaagccgactcgacaaggtggaagccgaggtccagatcgatagactgattaccggtaggcttcagtcgctgcaaacgtacgtgacacagcagttgatccgcgcagctgagattcgggcctcagcaaacctcgccgctaccaaaatgtctgaatgcgttctggggcagagtaagagagtggacttctgtggaaaaggctaccacctaatgtcctttccccaaagcgcgccacatggtgtcgtgttcctgcacgttacttatgtgccggcccaggagaagaattttaccacagctcctgcaatctgccacgatggcaaagcccatttccccagggaaggggtctttgtatctaacggaactcactggttcgtgacccagcgcaatttttacgagccacagataattacaacggacaacaccttcctcagcggcaattgtgatgttgtgatcgggatcgtcaacaatactgtgtatgaccccctgcaacctgagcttgattccttcaaggaagagttggacaaatactttaagaaccatacatcaccagatgtagacctgggagatattagtggcatcaatgccagcgtggtcaacattcagaaggaaatagaccgattaaatgaggttgctaaaaacctcaacgaatctctgatcgaccttcaggagctgggtaagtatgagcagtacattaaatggccctggtatatctggctagggttcattgcaggactcatcgccatagtgatggtgaccatcatgctgtgctgtatgacttcctgctgttcatgcttgaagggctgttgcagttgtggtagctgctgcaaatttgatgaagacgattccgagcctgtcctgaagggcgtgaagttacactacacatga

SEQ ID NO: 12026 - RNA, 3822 nt, synthetic construct
  misc_feature 1..3822: note = SARS-CoV-2/USA/UT-00034/2020__EPI_ISL_417977 spike protein CDS human (1-1273)
  source 1..3822: mol_type = other RNA
atgttcgtgtttctggtcctccttcccctggttagctcccagtgcgtgaacttgaccacaagaactcaattacctccagcctacactaattctttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactattacaaaaataacaagtcctggatggagtctgagttccgtgtgtatagctccgcgaataactgtacttttgagtacgtgtcacaacctttcctgatggacctggaaggcaagcagggtaattttaaaaacctcagagagttcgtctttaagaacattgatgggtacttcaaaatctatagtaagcataccccaataaatttagttagggacctgccccagggatttagcgctcttgagcctttggtggatctgccaatcggcattaacatcacacggttccagactctactcgccctgcaccgctcttaccttaccccgggcgactcctcaagcgggtggacagcaggagccgctgcatattacgtaggttatctgcaacccagaacctttttgctcaaatacaatgaaaacggcacgattactgatgccgtggactgcgctctggatcctttaagtgagacaaagtgtaccctgaagtctttcactgtcgaaaaagggatctatcagacatccaattttagggtgcagccaaccgagagcatagttcggttccccaacattacgaatctctgcccttttggagaggtgttcaacgccacccgcttcgcgtcggtctacgcatggaatcgaaagagaatctctaactgtgtggccgactactccgtactttataattcagctagttttagcacattcaaatgctacggcgtttccccaactaagctgaacgacttgtgttttaccaatgtgtatgccgattctttcgtcattaggggtgacgaagtgcggcagatcgcacccgggcaaacaggaaaaatcgctgattacaactataagctaccggacgattttactggctgcgtcattgcctggaatagcaacaacctggactcaaaagtgggcgggaattacaactatctctaccgtctgttccgcaagagtaatcttaagccttttgagagagatatatccaccgaaatctaccaggcgggaagcacaccctgtaacggtgttgagggcttcaattgctattttccactgcagtcttacgggttccaacctaccaacggagtgggctatcagccctacagggtagtcgtgttgtcatttgaactcctgcatgccccagcaactgtttgcggtcccaaaaagagtacgaatttagtgaaaaacaagtgtgtcaatttcaactttaatgggctgacaggcaccggagtgctaactgagagcaacaaaaagttcctccctttccagcagtttggccgggacattgctgataccacagacgccgtacgagatccacaaaccctggagatccttgacataactccgtgctccttcgggggagtgtctgttattacacccggtacgaatacctcgaaccaggtcgctgtgttgtatcagggcgtgaattgtactgaagtccctgttgccatccacgcagaccagctgacaccaacctggcgcgtgtacagcacagggtccaacgtgtttcaaactagagccggatgcctcatcggcgctgagcacgtaaacaattcatatgaatgtgatattcccatcggtgcggggatttgcgcaagttaccagacccagacgaactctcctaggcgggcccgcagcgtcgcttcccagtcaataatcgcctacaccatgagcctgggcgcagaaaattctgtggcctattccaacaatagtattgctatcccaacaaacttcactatcagcgttaccacagaaattcttcccgtgtctatgactaagacctccgtcgactgtacgatgtacatatgcggagattcaacagagtgtagtaatctgttgctccaatatggcagcttttgcacccagctgaacagagccttaactgggatcgcagtggagcaggacaaaaatacacaggaagttttcgcgcaagtgaagcagatttacaaaaccccgcctatcaaggattttggaggtttcaacttttcgcagattctgccagacccctccaaaccttctaagaggagcttcatcgaggatctactctttaataaggtaactctggctgacgccggcttcataaaacaatatggggattgtcttggagacatcgcagcccgtgatttgatttgcgctcagaagttcaacggcctgaccgtcctgcccccactcttaacagacgaaatgatcgcccagtacacgtcagcactgcttgctggtaccattacgagtgggtggacatttggcgccggagcggccttgcagatccctttcgctatgcaaatggcatatcggtttaatggcataggggtgacccagaacgtgctctacgagaatcagaaactgattgccaaccagttcaactccgctatcggaaagattcaagattctctaagctccacagcctcagcactgggcaaactccaggacgtcgttaatcagaacgcgcaggccctgaatactcttgtgaagcaattgagcagtaactttggtgctatctcttccgtactgaatgacatattaagccgactcgataaggtggaagccgaggtccagatcgacagactgattaccgggaggcttcagtcgctgcaaacgtacgtgacacagcagttgatccgcgcagctgagattcgggcctcagcaaacctcgccgctaccaaaatgtctgaatgcgttctgggacagagtaagagagtggatttctgtggcaaaggttatcatctaatgtcctttccccaaagcgcgccacacggcgtcgtgttcctgcatgttacttacgtgccggcccaggagaagaattttaccacagctcctgcaatctgccacgacgggaaagcccacttccccagggaaggagtctttgtatctaacggcactcattggttcgtgacccagcgcaatttttatgagccacagataattacaacggataacaccttcgttagcgggaattgtgacgtggtcatcggaatcgtgaacaatactgtatacgatcccctccaacctgagctggactccttcaaggaagaacttgataaatattttaagaaccacacatcaccagacgtggatttgggcgacattagtggtatcaatgccagcgtcgttaacattcagaaggaaatagatcgactgaatgaggtggctaaaaacttaaacgaatctctcatcgacctgcaggagcttgggaagtacgagcagtatattaaatggccctggtacatctggctgggattcattgcaggcctaatcgccatagtgatggtcaccatcatgctctgctgtatgacttcctgctgttcatgcctgaagggttgttgcagttgtggcagctgctgcaaatttgacgaagatgactccgagcctgtgttgaagggggttaagctgcattacacatga

SEQ ID NO: 12027 - RNA, 3822 nt, synthetic construct
  misc_feature 1..3822: note = SARS-CoV-2/USA/UT-00033/2020__EPI_ISL_417976 spike protein CDS human (1-1273)
  source 1..3822: mol_type = other RNA
atgttcgtgtttctggtcctccttcccctggttagctcccagtgcgtgaacttgaccacaagaactcaattacctccagcctacactaattctttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgagttccgtgtgtacagctccgcgaataactgtacttttgaatatgtgtcacaacctttcctgatggacctggaaggcaagcagggtaattttaaaaacctcagagagttcgtctttaagaacattgatgggtacttcaaaatctacagtaagcacaccccaataaatttagttagggacctgccccagggatttagcgctcttgagcctttggtggatctgccaatcggcattaacatcacacggttccagactctactcgccctgcatcgctcttatcttaccccgggcgactcctcaagcgggctgacagcaggagccgctgcatactatgtaggttacttgcaacccagaacctttctcctgaaatataatgaaaacggcacgattactgatgccgtggactgcgctttagatcctctgagtgagacaaagtgtaccctcaagtctttcactgtcgaaaaagggatctaccagacatccaattttagggtgcagccaaccgagagcatagttcggttccccaacattacgaatctttgcccttttggagaggtgttcaacgccacccgcttcgcgtcggtctatgcatggaatcgaaagagaatctctaactgtgtggccgactactccgtactgtacaattcagctagttttagcacattcaaatgctatggcgtttccccaactaagttgaacgacctatgttttaccaatgtgtacgccgattctttcgtcattaggggtgacgaagtgcggcagatcgcacccgggcaaacaggaaaaatcgctgattataactacaagctgccggacgattttactggctgcgtcattgcctggaatagcaacaacctcgactcaaaagtgggcgggaattataactacctgtatcgtcttttccgcaagagtaatctgaagccttttgagagagatatatccaccgaaatctaccaggcgggaagcacaccctgtaacggtgttgagggcttcaattgctactttccattgcagtcttatgggttccaacctaccaacggagtgggctaccagccctatagggtagtcgtgctctcatttgaactgttacacgccccagcaactgtttgcggtcccaaaaagagtacgaatctggtgaaaaacaagtgtgtcaatttcaactttaatgggctaacaggcaccggagtgctcactgagagcaacaaaaagttcctgcctttccagcagtttggccgggacattgctgataccacagacgccgtacgagatccacaaacccttgagatcttggacataactccgtgctccttcgggggagtgtctgttattacacccggtacgaatacctcgaaccaggtcgctgtgctgtaccagggcgtgaattgtactgaagtccctgttgccatccacgcagaccagctcacaccaacctggcgcgtgtatagcacagggtccaacgtgtttcaaactagagccggatgcctgatcggcgctgagcatgtaaacaattcatacgaatgtgatattcccatcggtgcggggatttgcgcaagttatcagacccagacgaactctcctaggcgggcccgcagcgtcgcttcccagtcaataatcgcctacaccatgagccttggcgcagaaaattctgtggcctactccaacaatagtattgctatcccaacaaacttcactatcagcgttaccacagaaattctgcccgtgtctatgactaagacctccgtcgactgtacgatgtatatatgcggagattcaacagagtgtagtaatttgctcctgcaatacggcagcttttgcacccagttaaacagagccctgactgggatcgcagtggagcaggacaaaaatacacaggaagttttcgcgcaagtgaagcagatttataaaaccccgcctatcaaggattttggaggtttcaacttttcgcagattctaccagacccctccaaaccttctaagaggagcttcatcgaggatctcctgtttaataaggtaactcttgctgacgccggcttcataaaacaatacggggattgtttgggagacatcgcagcccgtgatctgatttgcgctcagaagttcaacggcctcaccgtcctgcccccattactgacagacgaaatgatcgcccagtatacgtcagcacttttggctggtaccattacgagtgggtggacatttggcgccggagcggccctccagatccctttcgctatgcaaatggcataccggtttaatggcataggggtgacccagaacgtgctgtatgagaatcagaaactaattgccaaccagttcaactccgctatcggaaagattcaagattctctgagctccacagcctcagcactcggcaaactgcaggacgtcgttaatcagaacgcgcaggcccttaatactttggtgaagcaactgagcagtaactttggtgctatctcttccgtattaaatgacatactcagccgactggataaggtggaagccgaggtccagatcgacagacttattaccgggaggctgcagtcgttgcaaacgtacgtgacacagcagctcatccgcgcagctgagattcgggcctcagcaaacctggccgctaccaaaatgtctgaatgcgttctaggacagagtaagagagtggatttctgtggcaaaggttaccacctgatgtcctttccccaaagcgcgccacatggcgtcgtgttcctccacgttacttatgtgccggcccaggagaagaattttaccacagctcctgcaatctgccacgacgggaaagcccatttccccagggaaggagtctttgtatctaacggcactcactggttcgtgacccagcgcaatttttacgagccacagataattacaacggataacaccttcgttagcgggaattgtgacgtggtcatcggaatcgtgaacaatactgtatatgatcccctgcaacctgagcttgactccttcaaggaagagttggataaatactttaagaaccatacatcaccagacgtggatctgggcgacattagtggtatcaatgccagcgtcgttaacattcagaaggaaatagatcgattaaatgaggtggctaaaaacctcaacgaatctctgatcgaccttcaggagctggggaagtatgagcagtacattaaatggccctggtatatctggctaggattcattgcaggcctcatcgccatagtgatggtcaccatcatgctgtgctgtatgacttcctgctgttcatgcttgaagggttgttgcagttgtggcagctgctgcaaatttgacgaagatgactccgagcctgtgctgaagggggttaagttacactacacatga

SEQ ID NO: 12028 - RNA, 3822 nt, synthetic construct
  misc_feature 1..3822: note = SARS-CoV-2/USA/WI-13/2020__EPI_ISL_417516 spike protein CDS human (1-1273)
  source 1..3822: mol_type = other RNA
atgttcgtgtttctggtcctccttcccctggttagctcccagtgcgtgaacttgaccacaagaactcaattacctccagcctacactaattctttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgagttccgtgtgtacagctccgcgaataactgtacttttgaatatgtgtcacaacctttcctgatggacctggaaggcaagcagggtaattttaaaaacctcagagagttcgtctttaagaacattgatgggtacttcaaaatctacagtaagcacaccccaataaatttagttagggacctgccccagggatttagcgctcttgagcctttggtggatctgccaatcggcattaacatcacacggttccagactctactcgccctgcatcgctcttatcttaccccgggcgactcctcaagcgggtggacagcaggagccgctgcatactatgtaggttacctgcaacccagaacctttttgctcaaatataatgaaaacggcacgattactgatgccgtggactgcgctctggatcctttaagtgagacaaagtgtaccctgaagtctttcactgtcgaaaaagggatctaccagacatccaattttagggtgctcccaaccgagagcatagttcggttccccaacattacgaatctttgcccttttggagaggtgttcaacgccacccgcttcgcgtcggtctatgcatggaatcgaaagagaatctctaactgtgtggccgactactccgtactgtacaattcagctagttttagcacattcaaatgctatggcgtttccccaactaagttgaacgacctatgttttaccaatgtgtacgccgattctttcgtcattaggggtgacgaagtgcggcagatcgcacccgggcagacaggaaaaatcgctgattataactacaagctgccggacgattttactggctgcgtcattgcctggaatagcaacaacctcgactcaaaagtgggcgggaattataactacctgtatcgtcttttccgcaagagtaatctgaagccttttgagagagatatatccaccgaaatctaccaagcgggaagcacaccctgtaacggtgttgagggcttcaattgctactttccattgcagtcttatgggttccagcctaccaacggagtgggctaccaaccctatagggtagtcgtgctctcatttgaactgttacacgccccagcaactgtttgcggtcccaaaaagagtacgaatctggtgaaaaacaagtgtgtcaatttcaactttaatgggctaacaggcaccggagtgctcactgagagcaacaaaaagttcctgcctttccagcagtttggccgggacattgctgataccacagacgccgtacgagatccacagacccttgagatcttggacataactccgtgctccttcgggggagtgtctgttattacacccggtacgaatacctcgaaccaagtcgctgtgctgtaccagggcgtgaattgtactgaagtccctgttgccatccacgcagaccagctcacaccaacctggcgcgtgtatagcacagggtccaacgtgtttcagactagagccggatgcctgatcggcgctgagcatgtaaacaattcatacgaatgtgatattcccatcggtgcggggatttgcgcaagttatcaaacccagacgaactctcctaggcgggcccgcagcgtcgcttcccagtcaataatcgcctacaccatgagccttggcgcagaaaattctgtggcctactccaacaatagtattgctatcccaacaaacttcactatcagcgttaccacagaaattctgcccgtgtctatgactaagacctccgtcgactgtacgatgtatatatgcggagattcaacagagtgtagtaatttgctcctgcagtacggcagcttttgcacccaattaaacagagccctgactgggatcgcagtggagcaggacaaaaatacacaggaagttttcgcacaggtgaagcaaatttataaaaccccgcctatcaaggattttggaggtttcaacttttcgcagattctaccagacccctccaaaccttctaagaggagcttcatcgaggatctcctgtttaataaggtaactcttgctgacgccggcttcataaaacagtacggggattgtttgggagacatcgcagcccgtgatctgatttgcgctcaaaagttcaacggcctcaccgtcctgcccccattactgacagacgaaatgatcgcccagtatacgtcagcacttttggctggtaccattacgagtgggtggacatttggcgccggagcggccctccagatccctttcgctatgcagatggcataccggtttaatggcataggggtgacccaaaacgtgctgtatgagaatcagaaactaattgccaaccagttcaactccgctatcggaaagattcaggattctctgagctccacagcctcagcactcggcaaactgcaagacgtcgttaatcagaacgcgcaggcccttaatactttggtgaagcagctgagcagtaactttggtgctatctcttccgtattaaatgacatactcagccgactggataaggtggaagccgaggtccaaatcgacagacttattaccgggaggctgcagtcgttgcagacgtacgtgacacaacagctcatccgcgcagctgagattcgggcctcagcaaacctggccgctaccaaaatgtctgaatgcgttctaggacagagtaagagagtggatttctgtggcaaaggttaccacctgatgtcctttccccagagcgcgccacatggcgtcgtgttcctccacgttacttatgtgccggcccaagagaagaattttaccacagcgcctgctatctgccacgacgggaaagcccatttccccagggaaggagtctttgtatctaacggcactcactggttcgtgacccagcgcaatttttacgagccacagataattacaacggataacaccttcgttagcgggaattgtgacgtggtcatcggaatcgtgaacaatactgtatatgatcccctgcagcctgagcttgactccttcaaggaagagttggataaatactttaagaaccatacatcaccagacgtggatctgggcgacattagtggtatcaatgccagcgtcgttaacattcaaaaggaaatagatcgattaaatgaggtggctaaaaacctcaacgaatctctgatcgaccttcaggagctggggaagtatgagcagtacattaaatggccctggtatatctggctaggattcattgcaggcctcatcgccatagtgatggtcaccatcatgctgtgctgtatgacttcctgctgttcatgcttgaagggttgttgcagttgtggcagctgctgcaaatttgacgaagatgactccgagcctgtgctgaagggggttaagttacactacacatga

SEQ ID NO: 12029 - RNA, 3819 nt, synthetic construct
  misc_feature 1..3819: note = SARS-CoV-2/India/1-27/2020__EPI_ISL_413522 spike protein CDS human (1-1272)
  source 1..3819: mol_type = other RNA
atgttcgtgtttctggtcctccttcccctggttagctcccagtgcgtgaacttgaccacaagaactcaattacctccagcctacacgaatagcttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctaccataaaaataacaagtcctggatggagtctgagttccgtgtgtatagctccgcgaataactgtacttttgaatacgtgtcacaacctttcctgatggacctggaaggcaagcagggtaattttaaaaacctcagagagttcgtctttaagaacattgatgggtatttcaaaatctacagtaagcacaccccaataaatttagttagggacctgccccagggatttagcgctcttgagcctttggtggatctgccaatcggcattaacatcacacggttccagactctactcgccctgcatcgctcttaccttaccccgggcgactcctcaagcgggtggacagcaggagccgctgcatattacgtaggttatctgcaacccagaacctttttgctcaaatacaatgaaaacggcacgattactgatgccgtggactgcgctctggatcctttaagtgagacaaagtgtaccctgaagtctttcactgtcgaaaaagggatctatcagacatccaattttagggtgcagccaaccgagagcatagttcggttccccaacattacgaatctctgcccttttggagaggtgttcaacgccacccgcttcgcgtcggtctacgcatggaatcgaaagagaatctctaactgtgtggccgactattccgtactttacaattcagctagttttagcacattcaaatgctacggcgtttccccaactaagctgaacgacttgtgttttaccaatgtgtatgccgattctttcgtcattaggggtgacgaagtgatccagatcgcacccgggcaaacaggaaaaattgctgattacaactataagctaccggacgattttactggctgcgtcatagcctggaatagcaacaacctggactcaaaagtgggcgggaattacaactatctctaccggctgttccgtaagagtaatcttaagccttttgagcgcgatatctccaccgaaatttatcaggcgggaagcacaccctgtaacggtgttgagggcttcaattgctactttccactgcagtcttacgggttccaacctaccaacggagtgggctatcagccctacagagtagtcgtgttgtcatttgaactcctgcacgccccagcaactgtttgcggtcccaaaaagagtacgaatttagtgaaaaacaagtgtgtcaatttcaactttaatgggctgacaggcaccggagtgctaactgagagcaacaaaaagttcctccctttccagcagtttggcagggacatcgctgataccacagacgccgtacgggatccacaaaccctggagatacttgacattactccgtgctccttcgggggagtgtctgttatcacacccggtacgaatacctcgaaccaggtcgctgtgttgtatcaggacgtgaattgtactgaagtccctgttgccatccacgcagatcagctgacaccaacctggcgagtgtacagcacaggctccaacgtgtttcaaactcgcgccgggtgcctcattggagctgagcatgtaaacaattcatatgaatgtgacatccccattggcgcgggtatatgcgcaagttaccagacccagacgaactctcctagaagggcccggagcgtcgcttcccagtcaatcattgcctataccatgagcctgggggcagaaaattctgtggcctactccaacaatagtatcgctatcccaacaaacttcactattagcgttaccacagaaatacttcccgtgtctatgactaagacctccgtcgattgtacgatgtacatctgcggcgactcaacagagtgtagtaatctgttgctccaatatggatctttttgcacccagctgaaccgcgccttaactggcattgcagtggagcaggataaaaatacacaggaagttttcgcgcaagtgaagcagatctacaaaaccccgcctattaaggactttgggggattcaacttttcgcagatcctgccagatccctccaaaccttctaagagaagtttcatagaggacctactctttaataaggtaactctggctgatgccggtttcatcaaacaatatggcgactgtcttggggatattgcagccagggacttgatctgcgctcagaagttcaacggactgaccgtcctgcccccactcttaacagatgaaatgattgcccagtacacgtcagcactgcttgctggcaccatcactagcggttggacatttggggccggcgcggccttgcagatacctttcgctatgcaaatggcatatcgttttaatggaattggcgtgacccagaacgtgctctacgagaatcagaaactgatcgccaaccagttcaactccgctattgggaagatccaagactctctaagctccacagcctcagcactgggaaaactccaggacgtcgttaatcagaacgcgcaggccctgaatactcttgtgaagcaattgagcagtaactttggcgctatatcttccgtactgaatgatatcttaagccggctcgacaaggtggaagccgaggtccagattgatcgactgatcaccggtagacttcagtcgctgcaaacgtatgtgacacagcagttgattagggcagctgagatccgcgcctcagcaaacctcgccgctaccaaaatgtctgaatgcgttctggggcagagtaagcgggtggacttctgtggaaaaggctaccacctaatgtcctttccccaaagcgcgccacatggtgtcgtgttcctgcacgttacttacgtgccggcccaggagaagaattttaccacagctcctgcaatatgccacgatggcaaagcccatttccccagagaaggggtctttgtatctaacggaactcactggttcgtgacccagaggaatttttatgagccacagattatcacaacggacaacaccttcgttagcggcaattgtgatgtggtcatcgggattgtgaacaatactgtatacgaccccctccaacctgagctggattccttcaaggaggaacttgacaaatattttaagaaccatacatcaccagatgtggacttgggagatatcagtggcattaatgccagcgtcgttaacatacagaaggaaatcgaccgcctgaatgaggtggctaaaaacttaaacgaatctctcattgacctgcaggagcttggtaagtacgagcagtatatcaaatggccctggtacatttggctggggttcatcgcaggactaatagccatcgtgatggtcaccattatgctctgctgtatgacttcctgctgttcatgcctgaagggctgttgcagttgtggtagctgctgcaaatttgatgaagacgattccgagcctgtgttgaagggcgttaagctgcactatacatga

SEQ ID NO: 12030 - RNA, 3804 nt, synthetic construct
  misc_feature 1..3804: note = SARS-CoV-2/pangolin/Guangxi/P4L/2017__EPI_ISL_410538 spike protein CDS human (1-1267)
  source 1..3804: mol_type = other RNA
atgttcgtgtttctgttcgtcctcccccttgttagctcccagtgcgtgaacctgaccacaagaactggcatccctccagggtacacgaatagctcaaccaggggagtatattacccggacaaggtgtttcggagtagcattttgcacttaacacaagatctgttcctaccctttttctccaacgtcacttggtttaataccataaactatcagggtggcttcaaaaagtttgacaatcctgtgctcccattcaacgatggggtttactttgcctctacagagaaatcgaatatcattcgcggatggatcttcggcaccactctggacgctcgaacacagtcacttctgattgtgaacaatgcaaccaacgtcgtgatcaaggtatgtgaatttcagttctgcacggatcccttcttgggtgtttattaccataataacaataaaacttgggtggagaacgaatttcgtgtctatagcagtgccaataactgtaccttcgagtacatatcccaaccttttctcatggacctggaagggaagcagggaaacttcaagaatctgagagagtttgtgttcaaaaacgtggatggctactttaagatctattctaaacacacaccaattgacctcgtcagggatttaccccggggcttcgcggctctggagcctcttgttgacttgccaatcgggattaatatcactcgctttcagaccctgctagccctccatagaagctacctgacaccgggaaaccttgaatccggttggaccacgggcgcagccgcttattacgtggggtatctgcagcaaaggactttcttgctctcatacaatcagaacggaacaataaccgatgcagtagactgcagtctggatcccttaagcgagactaagtgtacactgaaatctctcaccgtggaaaagggcatttatcagacgtccaattttcgggtccagcctaccatctcaattgtgcgcttcccaaacatcacaaatctttgcccctttggtgaggttttcaacgccagcaagttcgctagtgtgtacgcctggaatcgaaaaagaatctctaactgtgtcgcggactactccgtgctgtataatagcacttcgttttctaccttcaagtgctacggggtatcccctacaaaattgaacgacctatgttttactaatgtttatgcagattcattcgtggtcaagggagacgaggtgaggcaaattgccccaggccagaccggcgtcatagctgattacaactataaactgcccgacgattttacagggtgcgtgatcgcctggaacagtgttaagcaggacgcactcaccggaggtaattacggctatctgtaccggcttttccgtaaaagcaagctgaagccgtttgaacgcgatatttccactgagatctaccaagctgggtctacgccttgtaacggacaggtgggcttgaattgctattaccccctcgaaagatatggtttccacccaacaaccggggtaaactaccagccttttagggtcgtggttctgagcttcgagttactgaatggccccgccactgtgtgcggaccaaaactatcaaccacactcgtcaaggacaaatgtgtgaactttaatttcaacggcctgaccgggactggagtacttacaacgagtaagaaacagtttttgcccttccaacagttcggtcgggatatatccgacaccactgatgcggtgcgagaccctcagacactggaaattctcgacatcaccccatgcagctttggcggggtttctgtcatcacaccgggaactaatacctcaaaccaggtggccgtgctgtatcaagatgtcaattgtacggaggttcccatggcaattcatgctgagcagcttacccctgcctggcgcgtgtacagtgctggcgccaacgtgttccagacaagagcaggttgcctggtaggggccgaacacgtcaataacagctatgagtgtgacatcccagtgggcgctggaatttgcgcgtcctaccactctatgtcgagcttgaggtccgttaatcagcggtcaataatcgcatacactatgagtctcggcgccgaaaactctgtggcttatagcaacaattccattgccatccccaccaactttacaatctcagtcactaccgagattctgcctgtgagcatgacgaagacatctgttgattgtaccatgtacatatgcggggactccatcgaatgtagtaatttactgctacaatatggatctttctgcactcagctcaaccgcgcactgacaggtattgccgtggagcaggataagaatacccaggaggtatttgctcaagtcaaacagatctacaagactccacccattaaagacttcggcgggtttaacttctctcagatccttccggatccttccaagccatcaaaaagaagttttatagaagacttgctgttcaataaggtgaccctcgccgatgcaggatttatcaagcaatatggcgactgtctgggtgatattgcggctagggacttaatctgcgcccagaaattcaacgggctgacagtgcttccccctttgctcacggatgagatgattgcacagtacaccagcgccctgctagctggcactatcacatcgggatggaccttcggcgccggggcagctctgcagataccctttgccatgcaaatggcgtatcgtttcaatggaattggcgtcacacagaacgttctctacgaaaatcagaagctgatcgccaaccagtttaattccgctattggtaaaatccaagactctcttagctcaactgcaagtgccttggggaagctgcaggacgtggtaaaccagaatgctcaggccttaaacaccctcgtgaaacaactgtcctctaacttcggagcaataagctccgtccttaatgatatcctgtcacggttggacaaggtggaggcggaagttcagattgatcgactcatcacgggcagactgcagagcctacaaacatacgtgacccagcagctgattagggccgctgagatccgcgccagtgcaaacctcgctgccactaagatgtctgagtgcgtcctgggtcagtccaaacgggtggacttttgtggcaaggggtatcatcttatgagcttcccacaatcggcacctcacggagttgtgtttttgcatgtcacctacgtacccgcccaggagaaaaatttcacaactgctccagcgatatgccacgagggcaaggcccactttccgagagaaggggtgttcgtttcaaacggaacccattggtttattacacagaggaatttctatgagcctcagatcatcacgaccgataacacttttgtgtctggcagttgtgacgtcgtgattggtatcgtaaataacacagtgtacgatcccctgcaaccagagttagactccttcaaagaagaactcgataagtatttcaaaaatcacaccagccccgacgtcgatctgggggacatttctggaataaacgcaagcgttgtgaatatccagaaggaaattgatcgccttaacgaggtggctaagaatctgaacgaatcccctatcgacctacaggagctcggcaaatacgagcagtatattaagtggccatggtacatctggctgggttttatagccggcttgatcgccattatcatggtcactattatgctgtgctgtatgacatcatgctgtagttgcttaaaagggtgttgcagctgtggatcttgctgcaagttcgacgaagatgactccgagcccgtgctcaaaggcgttaagctgcattacacctga

SEQ ID NO: 12031 - RNA, 3804 nt, synthetic construct
  misc_feature 1..3804: note = SARS-CoV-2/pangolin/Guangxi/P5L/2017__EPI_ISL_410540 spike protein CDS human (1-1267)
  source 1..3804: mol_type = other RNA
atgttcgtgtttctgttcgtcctcccccttgttagctcccagtgcgtgaacctgaccacaagaactggcatccctccagggtacacgaatagctcaaccaggggagtatattacccggacaaggtgtttcggagtagcattttgcacttaacacaagatctgttcctaccctttttctccaacgtcacttggtttaataccataaactatcagggtggcttcaaaaagtttgacaatcctgtgctcccattcaacgatggggtttactttgcctctacagagaaatcgaatatcattcgcggatggatcttcggcaccactctggacgctcgaacacagtcacttctgattgtgaacaatgcaaccaacgtcgtgatcaaggtatgtgaatttcagttctgcacggatcccttcttgggtgtttattaccataataacaataaaacttgggtggagaacgaatttcgtgtctatagcagtgccaataactgtaccttcgagtacatatcccaaccttttctcatggacctggaagggaagcagggaaacttcaagaatctgagagagtttgtgttcaaaaacgtggatggctactttaagatctattctaaacacacaccaattgacctcgtcagggatttaccccggggcttcgcggctctggagcctcttgttgacttgccaatcgggattaatatcactcgctttcagaccctgctagccctccatagaagctacctgacaccgggaaaacttgaatccggttggaccacgggcgcagccgcttattacgtggggtatctgcagcaaaggactttcttgctctcatacaaccagaatggaacaataaccgatgcagtagactgcagtctggatcccttaagcgagactaagtgtacactgaagtctctcaccgtggaaaagggcatttatcagacgtccaactttcgggtccagcctaccatctcaattgtgcgcttcccaaatatcacaaacctttgcccctttggtgaggttttcaatgccagcaaattcgctagtgtgtacgcctggaaccgaaagagaatctctaattgtgtcgcggactactccgtgctgtataacagcacttcgttttctaccttcaaatgctacggggtatcccctacaaagttgaatgacctatgttttactaacgtttatgcagattcattcgtggtcaaaggagacgaggtgaggcaaattgccccaggccagaccggcgtcatagctgattacaattataagctgcccgacgattttacagggtgcgtgatcgcctggaacagtgttaaacaggacgcactcaccggaggtaactacggctatctgtaccggcttttccgtaagagcaagctgaaaccgtttgaacgcgatatttccactgagatctaccaagctgggtctacgccttgtaatggacaggtgggcttgaactgctattaccccctcgaaagatatggtttccacccaacaaccggggtaaattaccagccttttagggtcgtggttctgagcttcgagttactgaacggccccgccactgtgtgcggaccaaagctatcaaccacactcgtcaaagacaagtgtgtgaattttaacttcaatggcctgaccgggactggagtacttacaacgagtaaaaagcagtttttgcccttccaacagttcggtcgggatatatccgacaccactgatgcggtgcgagaccctcagacactggaaattctcgacatcaccccatgcagctttggcggggtttctgtcatcacaccgggaactaacacctcaaatcaggtggccgtgctgtatcaagatgtcaactgtacggaggttcccatggcaattcatgctgagcagcttacccctgcctggcgcgtgtacagtgctggcgccaatgtgttccagacaagagcaggttgcctggtaggggccgaacacgtcaacaatagctatgagtgtgacatcccagtgggcgctggaatttgcgcgtcctaccactctatgtcgagctttaggtccgttaaccagcggtcaataatcgcatacactatgagtttgggcgccgaaaattctgtggcttatagcaacaactccattgccatccccaccaatttcacaatctcagtcactaccgagattctccctgtgagcatgacgaagacatctgttgattgtaccatgtacatatgcggggactccatcgaatgtagtaacctgttactgcaatatggatctttttgcactcagctaaatcgcgcactcacaggtattgccgtggagcaggataaaaacacccaggaggtattcgctcaagtcaagcagatctacaaaactccacccattaaggactttggcgggttcaatttttctcagatcctgccggatccttccaaaccatcaaagagaagtttcatagaagaccttttgtttaacaaggtgaccctggccgatgcaggattcatcaaacaatatggcgactgtctcggtgatattgcggctagggacctgatctgcgcccagaagttcaatgggttaacagtgctgccccctcttttgacggatgagatgattgcacagtacaccagcgccctcctggctggcactatcacatcgggatggacctttggcgccggggcagctctacagatacccttcgccatgcaaatggcgtatcgttttaacggaattggcgtcacacagaatgttctgtacgaaaaccagaaactcatcgccaatcagttcaactccgctattggtaagatccaagactctctgagctcaactgcaagtgcccttgggaaattgcaggacgtggtaaatcagaacgctcaggccctgaataccttagtgaagcaactctcctctaactttggagcaataagctccgtcctgaacgatatcctttcacggctggacaaggtggaggcggaagttcagattgatcgattgatcacgggcagactccagagcctgcaaacatacgtgacccagcagctaattagggccgctgagatccgcgccagtgcaaatctggctgccactaaaatgtctgagtgcgtcctcggtcagtccaagcgggtggacttctgtggcaaagggtatcatctgatgagctttccacaatcggcacctcacggagttgtgttccttcatgtcacctacgtacccgcccaggaaaagaactttacaactgctccagcgatatgccacgagggcaaagcccacttcccgagagaaggggtgtttgtttcaaatggaacccattggttcattacacagaggaacttttatgagcctcagatcatcacgaccgataatactttcgtgtctggcagttgtgacgtcgtgattggtatcgtaaacaatacagtgtacgatcccttgcaaccagagctggactccttcaaggaagagttagataaatattttaagaaccacaccagccccgacgtcgatctcggggacatttctggaataaatgcaagcgttgtgaacatccagaaggaaattgatcgcctgaatgaggtggctaaaaaccttaatgaatccctgatcgacctacaggagctcggcaagtacgagcagtatattaaatggccttggtacatctggctgggtttcatagccggcttgatcgccattatcatggtcactattatgctgtgctgtatgacatcatgctgtagttgcttaaaggggtgttgcagctgtggatcttgctgcaaatttgacgaagatgactccgagccagtgctcaagggcgttaagctgcattacacctga

SEQ ID NO: 12032 - RNA, 3804 nt, synthetic construct
  misc_feature 1..3804: note = SARS-CoV-2/pangolin/Guangxi/P5E/2017__EPI_ISL_410541 spike protein CDS human (1-1267)
  source 1..3804: mol_type = other RNA
atgttcgtgtttctgttcgtcctcccccttgttagctcccagtgcgtgaacctgaccacaagaactggcatccctccagggtacacaaattcttcaaccaggggagtatattacccggacaaggtgtttcggagtagcattttgcacttaacacaagatctgttcctaccctttttctccaacgtcacttggtttaataccataacatatcagggtggctctaaaaagttcgacaaccctgtgctcccatttaatgatggggtttacttcgcctcgaccgagaaatcaaacatcattcgcggatggatctttggcactacactggacgctcgaacccagagccttctgattgtgaataacgcaacgaatgtcgtgatcaaggtatgtgagttccagttttgcactgatcccttcttgggtgtttattaccataacaataacaaaacctgggtggaaaatgagttccgtgtctatagttccgccaacaattgtacatttgaatacatatctcaacctttcctcatggacctggaagggaagcagggaaactttaagaacctgagagagttcgtgtttaaaaatgtggatggctacttcaagatctatagcaaacacactccaattgacctcgtcagggatttaccccggggctttgcggctctggagcctcttgttgacttgccaatcgggattaacatcacccgcttccagacactgctagccctccatagatcctacctgaccccgggaaaacttgaatcaggttggacgactggcgcagccgcttattacgtggggtatctgcagcaaaggacatttttgctcagttacaatcagaacggaaccataactgatgcagtagactgcagcctggatcccttatctgagacaaagtgtaccctgaagtccctcacggtggaaaagggcatttatcagacctcaaatttccgggtccagcctacaatcagcattgtgcgctttccaaacatcactaatctttgccccttcggtgaggtttttaacgccagtaaattcgcttctgtgtacgcctggaatcgaaagagaatctccaactgtgtcgcggactacagcgtgctgtataattcgacctctttctccacatttaaatgctacggggtatcacctactaagttgaacgacctatgtttcaccaatgtttatgcagatagttttgtggtcaaaggagacgaggtgaggcaaattgccccaggccagacaggcgtcatagctgattacaactataagctgcccgacgatttcaccgggtgcgtgatcgcctggaatagcgttaaacaggacgcactcactggagataactacggttatctgtaccggctttttcgtaagtccaagctgaaaccgttcgaacgcgacatttctacggagatctaccaagctggcagcacaccttgtaacggacaggtggggttgaattgctattaccccctcgaaagatatggctttcacccaaccactggtgtaaactaccagcctttcagggtcgtggttctgtcatttgagttactgaatgggcccgccaccgtgtgcggcccaaagctaagtacaaccctcgtcaaagataagtgtgtgaacttcaattttaacggactgactggcacaggggtacttacgacctccaaaaagcagttcttgccctttcaacagttcggacgggacataagcgatactacagacgcggtgcgagaccctcagaccctggaaattctcgatatcacaccatgctctttcggtggcgtttcagtcatcactccggggaccaatacgagtaaccaggtggccgtgctgtatcaagacgtcaattgtaccgaggttcccatggcaattcatgctgagcagcttacgcctgcctggcgcgtgtacagcgctggagccaacgtgtttcagactagagcaggctgcctggtaggtgccgaacacgtcaataactcctatgagtgtgatatcccagtgggggctggcatttgcgcgtcttaccactcgatgagctccttcaggtcagttaatcagcggagtataatcgcatacaccatgtctttgggagccgaaaacagcgtggcttattccaataactcaattgccatccccacaaactttactatcagcgtcaccacggagattctccctgtgtctatgacaaagacctccgttgactgtactatgtacatatgcggcgatagtatcgaatgtagcaatctgttactgcaatatgggtctttctgcacacagctaaaccgcgcactcaccggaattgccgtggagcaggacaaaaatactcaggaggtatttgctcaagtcaagcagatctacaaaaccccacccattaaggatttcggtggctttaacttctcccagatcctgccggacccttcaaaaccaagtaagaggagctttatagaagatcttttgttcaataaggtgacactggccgacgcagggtttatcaaacaatatggagattgtctcggcgacattgcggctagagatctgatctgcgcccagaagttcaacggtttaacggtgctgccccctcttttgaccgacgagatgattgcacagtacacttcggccctcctggctgggacaatcacctccggctggacattcggagccggcgcagctctacagataccctttgccatgcaaatggcgtatcgtttcaatgggattggagtcactcagaacgttctgtacgaaaatcagaaactcatcgccaaccagtttaattctgctattggcaagatccaagacagcctgtcaagtaccgcatccgcccttggtaaattgcaggatgtggtaaaccagaatgctcaggccctgaacacgttagtgaagcaactctctagcaatttcggggcaatatcctcagtcctgaacgacatccttagccggctggataaggtggaggcggaagttcagattgaccgattgatcacaggaagactccagagtctgcaaacctacgtgactcagcagctaattagggccgctgagatccgcgcctctgcaaacctggctgccaccaaaatgtccgagtgcgtcctcggccagagcaagcgggtggatttttgtggtaaaggctatcatctgatgtcgttcccacaatcagcacctcacggggttgtgtttcttcatgtcacatacgtacccgcccaggaaaagaatttcactaccgctccagcgatatgccacgagggaaaagcccactttccgagagaaggcgtgttcgtttctaacgggacacattggtttattacgcagaggaatttctatgagcctcagatcatcaccactgacaacacatttgtgagtggatcctgtgatgtcgtgattggcatcgtaaataacaccgtgtacgaccccttgcaaccagagctggatagcttcaaggaagagttagacaaatatttcaagaatcacacttctcccgatgtcgacctcggtgatattagcgggataaacgcatccgttgtgaatatccagaaggaaattgaccgcctgaacgaggtggctaaaaatcttaacgaatcactgatcgacctacaggagctcggaaagtacgagcagtatattaaatggccttggtacatctggctgggctttatagccggtttgatcgccattatcatggtcacaattatgctgtgctgtatgaccagttgctgtagctgcttaaagggctgttgctcttgtgggtcctgctgcaaattcgatgaagacgattcagagccagtgctcaagggagttaagctgcattacacgtga

SEQ ID NO: 12033 - RNA, 3798 nt, synthetic construct
  misc_feature 1..3798: note = SARS-CoV-2/pangolin/Guangxi/P1E/2017__EPI_ISL_410539 spike protein CDS human (1-1265)
  source 1..3798: mol_type = other RNA
atgttcgtgtttctgttcgtcctcccccttgttagctcccagtgcgtgaacctgaccacaagaactggcatccaacctgggtacaccaattcttcaacgaggggagtatattacccagacaaggtgtttcggagtagcattttgcacttaacacaggatctgttcctaccgtttttctccaacgtcacttggtttaataccataaactatcagggtggcttcaagaagtttgacaatcccgtgctccctttcaacgatggggtttactttgcctctacagagaaatcgaatatcattcgcggatggatcttcggcaccactctggacgctcgaacacagtcacttctgattgtgaacaatgcaaccaacgtcgtgatcaaggtatgtgaatttcaattctgcacggatccattcttgggtgtttattaccataataacaataaaacttgggtggagaacgaatttcgtgtctatagcagtgccaataactgtaccttcgagtacatatcccagccctttctcatggacctggaagggaagcagggaaacttcaagaatctgagagagtttgtgttcaaaaacgtggatggctactttaagatctattctaaacacacacctattgacctcgtcagggatttaccacggggcttcgcggctctggagccccttgttgacttgcctatcgggattaatatcactcgctttcagaccctgctagccctccatagaagctacctgacaccaggaaaacttgaatccggttggaccacgggcgcagccgcttattacgtggggtatctgcaacagaggactttcttgctctcatacaaccagaatggaacaataaccgatgcagtagactgcagtctggatccgttaagcgagactaagtgtacactgaagtctctcaccgtggaaaagggcatttatcagacgtccaactttcgggtccaacccaccatctcaattgtgcgcttccctaatatcacaaacctttgcccatttggtgaggttttcaatgccagcaaattcgctagtgtgtacgcctggaaccgaaagagaatctctaattgtgtcgcggactactccgtgctgtataacagcacttcgttttctaccttcaaatgctacggggtatcccccacaaagttgaatgacctatgttttactaacgtttatgcagattcattcgtggtcaaaggagacgaggtgaggcagattgcccctggccagaccggcgtcatagctgattacaattataagctgccagacgattttacagggtgcgtgatcgcctggaacagtgttaaacaagacgcactcaccggaggtaactacctgtatcggcttttccgtaagagcaagctgaaaccctttgaacgcgatatttccactgagatctaccaggctggctctacgccgtgtaatggacaggtggggttgaactgctactatcctctcgaaagatacggcttccaccccacaaccggtgtaaattatcagccatttagggtcgtggttctgagcttcgagttactgaacgggcctgccactgtgtgcggccccaagctatcaaccacactcgtcaaagacaagtgtgtgaattttaacttcaatggactgaccggcactggggtacttacaacgagtaaaaagcaatttttgccattccagcagttcggacgggatatatccgacaccactgatgcggtgcgagacccccagacactggaaattctcgacatcaccccttgcagctttggtggcgtttctgtcatcacaccagggactaacacctcaaatcaagtggccgtgctgtaccaggatgtcaactgtacggaggttccgatggcaattcatgctgagcagcttacccccgcctggcgcgtgtatagtgctggagccaatgtgttccagacaagagcaggctgcctggtaggtgccgaacacgtcaacaatagctacgagtgtgacatccctgtgggggctggcatttgcgcgtcctatcactctatgtcgagcttgaggtccgttaaccaacggtcaataatcgcatacactatgagtctcggagccgaaaattctgtggcttacagcaacaactccattgccatcccaaccaattttacaatctcagtcactaccgagattctgcccgtgagcatgacgaagacatctgttgattgtaccatgtatatatgcggcgactccatcgaatgtagtaacttactgctacagtacgggagcttctgcactcagctcaatcgcgcactgacaggaattgccgtggagcaggataaaaacacccaagaggtatttgctcaggtcaagcagatctataaaactcctccaattaaggacttcggtggctttaatttctctcaaatccttcccgatccgtccaaaccttcaaagagaagttttatagaagacttgctgttcaacaaggtgaccctcgccgatgcagggtttatcaaacagtacggagactgtctgggcgatattgcggctagggacttaatctgcgcccagaagttcaatggtctgacagtgcttccacccttgctcacggatgagatgattgcacagtataccagcgccctgctagctgggactatcacatcgggctggaccttcggagccggcgcagctctgcaaataccttttgccatgcagatggcgtaccgtttcaacgggattggagtcacacagaatgttctctatgaaaaccagaaactgatcgccaatcaatttaactccgctattggcaagatccaggactctcttagctcaactgcaagtgccttgggtaaactgcaggacgtggtaaatcagaacgctcaagccttaaataccctcgtgaagcagctgtcctctaacttcggggcaataagctccgtccttaacgatatcctgtcacggttggacaaggtggaggcggaagttcagattgatcgactcatcacgggaagactgcaaagcctacagacatacgtgacccagcagctgattagggccgctgagatccgcgccagtgcaaatctcgctgccactaaaatgtctgagtgcgtcctgggccaatccaagcgggtggacttttgtggtaaaggctaccatcttatgagcttcccccagtcggcaccacacggggttgtgtttttgcatgtcacctatgtacctgcccaggaaaagaacttcacaactgctcccgcgatatgccacgagggaaaagcccactttccaagagaaggcgtgttcgtttcaaatgggacccattggtttattacacagaggaacttctacgagccgcaaatcatcacgaccgataatacttttgtgtctggaagttgtgacgtcgtgattggcatcgtaaacaatacagtgtatgatcctctgcagcccgagttagactccttcaaggaggaactcgataaatacttcaagaaccacaccagcccagacgtcgatctgggtgacatttctgggataaatgcaagcgttgtgaacatccagaaggaaattgatcgccttaatgaggtggctaaaaacctgaatgaatccctaatcgacctccaggagctgggaaagtatgagcaatacattaaatggccctggtatatctggttgggctttatagccggtctgatcgccattatcatggtcactattatgttatgctgtatgacatcatgctgtagttgcctcaagggctgttgcagctgtgggtcttgctgcaaattcgacgaagatgactccgagcctgtgctgaagggagttaaacttcattacacctga

SEQ ID NO: 12034 - RNA, 3822 nt, synthetic construct
  misc_feature 1..3822: note = SARS-CoV-2/Wuhan/WIV05/2019__EPI_ISL_402128 spike protein CDS gc mod (1-1273)
  source 1..3822: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctga

SEQ ID NO: 12035 - RNA, 3822 nt, synthetic construct; identical to SEQ ID NO: 146
  misc_feature 1..3822: note = SARS-CoV-2/Wuhan/WIV05/2019__EPI_ISL_402128 spike protein CDS gc mod (1-1273)(K986P_V987P)
  source 1..3822: mol_type = other RNA

SEQ ID NO: 12036 - RNA, 3822 nt, synthetic construct
  misc_feature 1..3822: note = SARS-CoV-2/Wuhan/WIV05/2019__EPI_ISL_402128 spike protein CDS gc mod (1-1273)(K986P_V987P_T887WN_A1020W)
  source 1..3822: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggtggtttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagatggtctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctga

SEQ ID NO: 12037 - RNA, 3822 nt, synthetic construct
  misc_feature 1..3822: note = SARS-CoV-2/Wuhan/WIV05/2019__EPI_ISL_402128 spike protein CDS gc mod (1-1273)(K986P_V987P_P1069F)
  source 1..3822: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgttcgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctga

SEQ ID NO: 12038 - RNA, 3822 nt, synthetic construct
  misc_feature 1..3822: note = SARS-CoV-2/Wuhan/WIV05/2019__EPI_ISL_402128 spike protein CDS gc mod (1-1273)(K986P_V987P_ H1048Q_H1064N_ H1083N_H1101N)
  source 1..3822: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccagctgatgagcttccctcagtctgcccctcacggcgtggtgtttctgaacgtgacatatgtgcccgctcaagagaagaatttcaccaccgctccagccatctgcaacgacggcaaagcccactttcctagagaaggcgtgttcgtgtccaacggcaccaactggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctga

SEQ ID NO: 12039 - RNA, 3822 nt, synthetic construct
  misc_feature 1..3822: note = SARS-CoV-2/Wuhan/WIV05/2019__EPI_ISL_402128 spike protein CDS gc mod (1-1273)(I712C_T1077C)
  source 1..3822: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactcttgcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcacctgtgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctga

SEQ ID NO: 12040 - RNA, 3822 nt, synthetic construct
  misc_feature 1..3822: note = SARS-CoV-2/Wuhan/WIV05/2019__EPI_ISL_402128 spike protein CDS gc mod (1-1273)(I714C_Y1110C)
  source 1..3822: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgcttgccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctgtgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctga

SEQ ID NO: 12041 - RNA, 3822 nt, synthetic construct
  misc_feature 1..3822: note = SARS-CoV-2/Wuhan/WIV05/2019__EPI_ISL_402128 spike protein CDS gc mod (1-1273)(P715C_P1069C)
  source 1..3822: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatctgcaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgtgtgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctga

SEQ ID NO: 12042 - RNA, 3822 nt, synthetic construct
  misc_feature 1..3822: note = SARS-CoV-2/Wuhan/WIV05/2019__EPI_ISL_402128 spike protein CDS gc mod (1-1273)(G889C_L1034C)
  source 1..3822: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacattttgcgctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgtgtggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctga

SEQ ID NO: 12043 - RNA, 3822 nt, synthetic construct
  misc_feature 1..3822: note = SARS-CoV-2/Wuhan/WIV05/2019__EPI_ISL_402128 spike protein CDS gc mod (1-1273)(I909C_Y1047C)
  source 1..3822: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggctgcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctgtcacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctga

SEQ ID NO: 12044 - RNA, 3822 nt, synthetic construct
  misc_feature 1..3822: note = SARS-CoV-2/Wuhan/WIV05/2019__EPI_ISL_402128 spike protein CDS gc mod (1-1273)(Q965C_S1003C)
  source 1..3822: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagtgcctgtcctccaacttcggcgccatcagctctgtgctgaacgatatcctgagcagactggacaaggtcgaggccgaggtgcagatcgacagactgatcacaggcagactgcagtgtctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctga

SEQ ID NO: 12045 - RNA, 3822 nt, synthetic construct
  misc_feature 1..3822: note = SARS-CoV-2/Wuhan/WIV05/2019__EPI_ISL_402128 spike protein CDS gc mod (1-1273)(F970C_G999C)
  source 1..3822: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaactgcggcgccatcagctctgtgctgaacgatatcctgagcagactggacaaggtcgaggccgaggtgcagatcgacagactgatcacatgtagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctga

SEQ ID NO: 12046 - RNA, 3822 nt, synthetic construct
  misc_feature 1..3822: note = SARS-CoV-2/Wuhan/WIV05/2019__EPI_ISL_402128 spike protein CDS gc mod (1-1273)(A972C_R995C)
  source 1..3822: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggctgcatcagctctgtgctgaacgatatcctgagcagactggacaaggtcgaggccgaggtgcagatcgactgtctgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctga

SEQ ID NO: 12047 - RNA, 3822 nt, synthetic construct
  misc_feature 1..3822: note = SARS-CoV-2/Wuhan/WIV05/2019__EPI_ISL_402128 spike protein CDS gc mod (1-1273)(A890C_V1040C)
  source 1..3822: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggatgcggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagatgtgacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctga

SEQ ID NO: 12048 - RNA, 3822 nt, synthetic construct
  misc_feature 1..3822: note = SARS-CoV-2/Wuhan/WIV05/2019__EPI_ISL_402128 spike protein CDS gc mod (1-1273)(T874C_S1055C)
  source 1..3822: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtactgctctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtgcgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctga

SEQ ID NO: 12049 - RNA, 2046 nt, synthetic construct; identical to SEQ ID NO: 147
  misc_feature 1..2046: note = SARS-CoV-2/Wuhan/WIV05/2019__EPI_ISL_402128 spike protein CDS gc mod (1-681)
  source 1..2046: mol_type = other RNA

SEQ ID NO: 12050 - RNA, 1776 nt, synthetic construct
  misc_feature 1..1776: note = SARS-CoV-2/Wuhan/WIV05/2019__EPI_ISL_402128 spike protein CDS gc mod (682-1273)
  source 1..1776: mol_type = other RNA
agacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacc

SEQ ID NO: 12051 - RNA, 45 nt, synthetic construct
  misc_feature 1..45: note = SARS-CoV-2/Wuhan/WIV05/2019__EPI_ISL_402128 spike protein CDS gc mod (1-15)
  source 1..45: mol_type = other RNA
atgttcgtgtttctggtgctgctgcccctggtgtccagccagtgt

SEQ ID NO: 12052 - RNA, 1998 nt, synthetic construct
  misc_feature 1..1998: note = SARS-CoV-2/Wuhan/WIV05/2019__EPI_ISL_402128 spike protein CDS gc mod (16-681)
  source 1..1998: mol_type = other RNA
gtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagcccc

SEQ ID NO: 12053 - RNA, 189 nt, synthetic construct
  misc_feature 1..189: note = SARS-CoV-2/Wuhan/WIV05/2019__EPI_ISL_402128 spike protein CDS gc mod (1212-1273)
  source 1..189: mol_type = other RNA
tggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctga

SEQ ID NO: 12054 - RNA, 3633 nt, synthetic construct
  misc_feature 1..3633: note = SARS-CoV-2/Wuhan/WIV05/2019__EPI_ISL_402128 spike protein CDS gc mod (1-1211)
  source 1..3633: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaag

SEQ ID NO: 12055 - RNA, 3633 nt, synthetic construct
  misc_feature 1..3633: note = SARS-CoV-2/Wuhan/WIV05/2019__EPI_ISL_402128 spike protein CDS gc mod (1-1211)(K986P_V987P)
  source 1..3633: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaag

SEQ ID NO: 12056 - RNA, 3633 nt, synthetic construct
  misc_feature 1..3633: note = SARS-CoV-2/Wuhan/WIV05/2019__EPI_ISL_402128 spike protein CDS gc mod (1-1211)(K986P_V987P_T887WN_A1020W)
  source 1..3633: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggtggtttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagatggtctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaag

SEQ ID NO: 12057 - RNA, 3633 nt, synthetic construct
  misc_feature 1..3633: note = SARS-CoV-2/Wuhan/WIV05/2019__EPI_ISL_402128 spike protein CDS gc mod (1-1211)(K986P_V987P_P1069F)
  source 1..3633: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgttcgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaag

SEQ ID NO: 12058 - RNA, 3633 nt, synthetic construct
  misc_feature 1..3633: note = SARS-CoV-2/Wuhan/WIV05/2019__EPI_ISL_402128 spike protein CDS gc mod (1-1211)(K986P_V987P_ H1048Q_H1064N_ H1083N_H1101N)
  source 1..3633: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccagctgatgagcttccctcagtctgcccctcacggcgtggtgtttctgaacgtgacatatgtgcccgctcaagagaagaatttcaccaccgctccagccatctgcaacgacggcaaagcccactttcctagagaaggcgtgttcgtgtccaacggcaccaactggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaag

SEQ ID NO: 12059 - RNA, 3633 nt, synthetic construct
  misc_feature 1..3633: note = SARS-CoV-2/Wuhan/WIV05/2019__EPI_ISL_402128 spike protein CDS gc mod (1-1211)(I712C_T1077C)
  source 1..3633: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactcttgcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcacctgtgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaag

SEQ ID NO: 12060 - RNA, 3633 nt, synthetic construct
  misc_feature 1..3633: note = SARS-CoV-2/Wuhan/WIV05/2019__EPI_ISL_402128 spike protein CDS gc mod (1-1211)(I714C_Y1110C)
  source 1..3633: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgcttgccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctgtgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaag

SEQ ID NO: 12061 - RNA, 3633 nt, synthetic construct
  misc_feature 1..3633: note = SARS-CoV-2/Wuhan/WIV05/2019__EPI_ISL_402128 spike protein CDS gc mod (1-1211)(P715C_P1069C)
  source 1..3633: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatctgcaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgtgtgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaag

SEQ ID NO: 12062 - RNA, 3633 nt, synthetic construct
  misc_feature 1..3633: note = SARS-CoV-2/Wuhan/WIV05/2019__EPI_ISL_402128 spike protein CDS gc mod (1-1211)(G889C_L1034C)
  source 1..3633: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacattttgcgctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgtgtggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaag

SEQ ID NO: 12063 - RNA, 3633 nt, synthetic construct
  misc_feature 1..3633: note = SARS-CoV-2/Wuhan/WIV05/2019__EPI_ISL_402128 spike protein CDS gc mod (1-1211)(I909C_Y1047C)
  source 1..3633: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggctgcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctgtcacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaag

SEQ ID NO: 12064 - RNA, 3633 nt, synthetic construct
  misc_feature 1..3633: note = SARS-CoV-2/Wuhan/WIV05/2019__EPI_ISL_402128 spike protein CDS gc mod (1-1211)(Q965C_S1003C)
  source 1..3633: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagtgcctgtcctccaacttcggcgccatcagctctgtgctgaacgatatcctgagcagactggacaaggtcgaggccgaggtgcagatcgacagactgatcacaggcagactgcagtgtctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaag

SEQ ID NO: 12065 - RNA, 3633 nt, synthetic construct
  misc_feature 1..3633: note = SARS-CoV-2/Wuhan/WIV05/2019__EPI_ISL_402128 spike protein CDS gc mod (1-1211)(F970C_G999C)
  source 1..3633: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaactgcggcgccatcagctctgtgctgaacgatatcctgagcagactggacaaggtcgaggccgaggtgcagatcgacagactgatcacatgtagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaag

SEQ ID NO: 12066 - RNA, 3633 nt, synthetic construct
  misc_feature 1..3633: note = SARS-CoV-2/Wuhan/WIV05/2019__EPI_ISL_402128 spike protein CDS gc mod (1-1211)(A972C_R995C)
  source 1..3633: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggctgcatcagctctgtgctgaacgatatcctgagcagactggacaaggtcgaggccgaggtgcagatcgactgtctgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaag

SEQ ID NO: 12067 - RNA, 3633 nt, synthetic construct
  misc_feature 1..3633: note = SARS-CoV-2/Wuhan/WIV05/2019__EPI_ISL_402128 spike protein CDS gc mod (1-1211)(A890C_V1040C)
  source 1..3633: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggatgcggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagatgtgacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaag

SEQ ID NO: 12068 - RNA, 3633 nt, synthetic construct
  misc_feature 1..3633: note = SARS-CoV-2/Wuhan/WIV05/2019__EPI_ISL_402128 spike protein CDS gc mod (1-1211)(T874C_S1055C)
  source 1..3633: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtactgctctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtgcgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaag

SEQ ID NO: 12069 - RNA, 3441 nt, synthetic construct
  misc_feature 1..3441: note = SARS-CoV-2/Wuhan/WIV05/2019__EPI_ISL_402128 spike protein CDS gc mod (1-1147)
  source 1..3441: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagc

SEQ ID NO: 12070 - RNA, 3441 nt, synthetic construct
  misc_feature 1..3441: note = SARS-CoV-2/Wuhan/WIV05/2019__EPI_ISL_402128 spike protein CDS gc mod (1-1147)(K986P_V987P)
  source 1..3441: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagc

SEQ ID NO: 12071 - RNA, 3441 nt, synthetic construct
  misc_feature 1..3441: note = SARS-CoV-2/Wuhan/WIV05/2019__EPI_ISL_402128 spike protein CDS gc mod (1-1147)(K986P_V987P_T887WN_A1020W)
  source 1..3441: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggtggtttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagatggtctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagc

SEQ ID NO: 12072 - RNA, 3441 nt, synthetic construct
  misc_feature 1..3441: note = SARS-CoV-2/Wuhan/WIV05/2019__EPI_ISL_402128 spike protein CDS gc mod (1-1147)(K986P_V987P_P1069F)
  source 1..3441: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgttcgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagc

SEQ ID NO: 12073 - RNA, 3441 nt, synthetic construct
  misc_feature 1..3441: note = SARS-CoV-2/Wuhan/WIV05/2019__EPI_ISL_402128 spike protein CDS gc mod (1-1147)(K986P_V987P_ H1048Q_H1064N_ H1083N_H1101N)
  source 1..3441: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccagctgatgagcttccctcagtctgcccctcacggcgtggtgtttctgaacgtgacatatgtgcccgctcaagagaagaatttcaccaccgctccagccatctgcaacgacggcaaagcccactttcctagagaaggcgtgttcgtgtccaacggcaccaactggttcgtgacacagcggaacttctacgagccccagatcatcaccaccgacaacaccttcgtgtctggcaactgcgacgttgtgatcggcattgtgaacaataccgtgtacgaccctctgcagcccgagctggacagc

SEQ ID NO: 12074 - RNA, 3441 nt, synthetic construct
  misc_feature 1..3441: note = SARS-CoV-2/Wuhan/WIV05/2019__EPI_ISL_402128 spike protein CDS gc mod (1-1147)(I712C_T1077C)
  source 1..3441: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactcttgcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcacctgtgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagc

SEQ ID NO: 12075 - RNA, 3441 nt, synthetic construct
  misc_feature 1..3441: note = SARS-CoV-2/Wuhan/WIV05/2019__EPI_ISL_402128 spike protein CDS gc mod (1-1147)(I714C_Y1110C)
  source 1..3441: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgcttgccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctgtgagccccagatcatcaccaccgacaacaccttcgtgtctggcaactgcgacgttgtgatcggcattgtgaacaataccgtgtacgaccctctgcagcccgagctggacagc

SEQ ID NO: 12076 - RNA, 3441 nt, synthetic construct
  misc_feature 1..3441: note = SARS-CoV-2/Wuhan/WIV05/2019__EPI_ISL_402128 spike protein CDS gc mod (1-1147)(P715C_P1069C)
  source 1..3441: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatctgcaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgtgtgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagc

SEQ ID NO: 12077 - RNA, 3441 nt, synthetic construct
  misc_feature 1..3441: note = SARS-CoV-2/Wuhan/WIV05/2019__EPI_ISL_402128 spike protein CDS gc mod (1-1147)(G889C_L1034C)
  source 1..3441: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacattttgcgctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgtgtggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagc

SEQ ID NO: 12078 - RNA, 3441 nt, synthetic construct
  misc_feature 1..3441: note = SARS-CoV-2/Wuhan/WIV05/2019__EPI_ISL_402128 spike protein CDS gc mod (1-1147)(I909C_Y1047C)
  source 1..3441: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggctgcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctgtcacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagc

SEQ ID NO: 12079 - RNA, 3441 nt, synthetic construct
  misc_feature 1..3441: note = SARS-CoV-2/Wuhan/WIV05/2019__EPI_ISL_402128 spike protein CDS gc mod (1-1147)(Q965C_S1003C)
  source 1..3441: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagtgcctgtcctccaacttcggcgccatcagctctgtgctgaacgatatcctgagcagactggacaaggtcgaggccgaggtgcagatcgacagactgatcacaggcagactgcagtgtctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagc

SEQ ID NO: 12080 - RNA, 3441 nt, synthetic construct
  misc_feature 1..3441: note = SARS-CoV-2/Wuhan/WIV05/2019__EPI_ISL_402128 spike protein CDS gc mod (1-1147)(F970C_G999C)
  source 1..3441: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaactgcggcgccatcagctctgtgctgaacgatatcctgagcagactggacaaggtcgaggccgaggtgcagatcgacagactgatcacatgtagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagc

SEQ ID NO: 12081 - RNA, 3441 nt, synthetic construct
  misc_feature 1..3441: note = SARS-CoV-2/Wuhan/WIV05/2019__EPI_ISL_402128 spike protein CDS gc mod (1-1147)(A972C_R995C)
  source 1..3441: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggctgcatcagctctgtgctgaacgatatcctgagcagactggacaaggtcgaggccgaggtgcagatcgactgtctgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagc

SEQ ID NO: 12082 - RNA, 3441 nt, synthetic construct
  misc_feature 1..3441: note = SARS-CoV-2/Wuhan/WIV05/2019__EPI_ISL_402128 spike protein CDS gc mod (1-1147)(A890C_V1040C)
  source 1..3441: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggatgcggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagatgtgacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagc

SEQ ID NO: 12083 - RNA, 3441 nt, synthetic construct
  misc_feature 1..3441: note = SARS-CoV-2/Wuhan/WIV05/2019__EPI_ISL_402128 spike protein CDS gc mod (1-1147)(T874C_S1055C)
  source 1..3441: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtactgctctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtgcgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagc

SEQ ID NO: 12084 - RNA, 4116 nt, synthetic construct
  misc_feature 1..4116: note = SARS-CoV-2/Wuhan/WIV05/2019__EPI_ISL_402128 spike protein CDS gc mod (1-1211) LumSynth construct
  source 1..4116: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggcggaggatctggcggaggacagatctacgagggcaagctgacagccgagggcctgagatttggaatcgtggccagccggttcaatcacgccctggtggatagactggtggaaggcgccatcgatgccattgtcagacacggcggcagagaagaggacatcaccctcgttagagtgcccggctcttgggagattcctgtggctgctggcgagctggcccggaaagaagatatcgacgccgttatcgccatcggcgtgctgatcagaggcgccacacctcacttcgactatatcgccagcgaggtgtccaaaggcctggccgatctgagcctggaactgagaaagcccatcaccttcggcgtgatcaccgctgacacactggaacaggccattgagagagccggcaccaagcacggcaacaaaggatgggaagccgctctgtccgccatcgagatggccaacctgttcaagagcctgcggtga

SEQ ID NO: 12085 - RNA, 4116 nt, synthetic construct
  misc_feature 1..4116: note = SARS-CoV-2/Wuhan/WIV05/2019__EPI_ISL_402128 spike protein CDS gc mod (1-1211)(K986P_V987P) LumSynth construct
  source 1..4116: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggcggaggatctggcggaggacagatctacgagggcaagctgacagccgagggcctgagatttggaatcgtggccagccggttcaatcacgccctggtggatagactggtggaaggcgccatcgatgccattgtcagacacggcggcagagaagaggacatcaccctcgttagagtgcccggctcttgggagattcctgtggctgctggcgagctggcccggaaagaagatatcgacgccgttatcgccatcggcgtgctgatcagaggcgccacacctcacttcgactatatcgccagcgaggtgtccaaaggcctggccgatctgagcctggaactgagaaagcccatcaccttcggcgtgatcaccgctgacacactggaacaggccattgagagagccggcaccaagcacggcaacaaaggatgggaagccgctctgtccgccatcgagatggccaacctgttcaagagcctgcggtga

SEQ ID NO: 12086 - RNA, 4116 nt, synthetic construct
  misc_feature 1..4116: note = SARS-CoV-2/Wuhan/WIV05/2019__EPI_ISL_402128 spike protein CDS gc mod (1-1211)(K986P_V987P_T887WN_A1020W) LumSynth construct
  source 1..4116: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggtggtttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagatggtctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggcggaggatctggcggaggacagatctacgagggcaagctgacagccgagggcctgagatttggaatcgtggccagccggttcaatcacgccctggtggatagactggtggaaggcgccatcgatgccattgtcagacacggcggcagagaagaggacatcaccctcgttagagtgcccggctcttgggagattcctgtggctgctggcgagctggcccggaaagaagatatcgacgccgttatcgccatcggcgtgctgatcagaggcgccacacctcacttcgactatatcgccagcgaggtgtccaaaggcctggccgatctgagcctggaactgagaaagcccatcaccttcggcgtgatcaccgctgacacactggaacaggccattgagagagccggcaccaagcacggcaacaaaggatgggaagccgctctgtccgccatcgagatggccaacctgttcaagagcctgcggtga

SEQ ID NO: 12087 - RNA, 4116 nt, synthetic construct
  misc_feature 1..4116: note = SARS-CoV-2/Wuhan/WIV05/2019__EPI_ISL_402128 spike protein CDS gc mod (1-1211)(K986P_V987P_P1069F) LumSynth construct
  source 1..4116: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgttcgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggcggaggatctggcggaggacagatctacgagggcaagctgacagccgagggcctgagatttggaatcgtggccagccggttcaatcacgccctggtggatagactggtggaaggcgccatcgatgccattgtcagacacggcggcagagaagaggacatcaccctcgttagagtgcccggctcttgggagattcctgtggctgctggcgagctggcccggaaagaagatatcgacgccgttatcgccatcggcgtgctgatcagaggcgccacacctcacttcgactatatcgccagcgaggtgtccaaaggcctggccgatctgagcctggaactgagaaagcccatcaccttcggcgtgatcaccgctgacacactggaacaggccattgagagagccggcaccaagcacggcaacaaaggatgggaagccgctctgtccgccatcgagatggccaacctgttcaagagcctgcggtga

SEQ ID NO: 12088 - RNA, 4116 nt, synthetic construct
  misc_feature 1..4116: note = SARS-CoV-2/Wuhan/WIV05/2019__EPI_ISL_402128 spike protein CDS gc mod (1-1211)(K986P_V987P_ H1048Q_H1064N_ H1083N_H1101N) LumSynth construct
  source 1..4116: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccagctgatgagcttccctcagtctgcccctcacggcgtggtgtttctgaacgtgacatatgtgcccgctcaagagaagaatttcaccaccgctccagccatctgcaacgacggcaaagcccactttcctagagaaggcgtgttcgtgtccaacggcaccaactggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggcggaggatctggcggaggacagatctacgagggcaagctgacagccgagggcctgagatttggaatcgtggccagccggttcaatcacgccctggtggatagactggtggaaggcgccatcgatgccattgtcagacacggcggcagagaagaggacatcaccctcgttagagtgcccggctcttgggagattcctgtggctgctggcgagctggcccggaaagaagatatcgacgccgttatcgccatcggcgtgctgatcagaggcgccacacctcacttcgactatatcgccagcgaggtgtccaaaggcctggccgatctgagcctggaactgagaaagcccatcaccttcggcgtgatcaccgctgacacactggaacaggccattgagagagccggcaccaagcacggcaacaaaggatgggaagccgctctgtccgccatcgagatggccaacctgttcaagagcctgcggtga

SEQ ID NO: 12089 - RNA, 4116 nt, synthetic construct
  misc_feature 1..4116: note = SARS-CoV-2/Wuhan/WIV05/2019__EPI_ISL_402128 spike protein CDS gc mod (1-1211)(I712C_T1077C) LumSynth construct
  source 1..4116: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactcttgcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcacctgtgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggcggaggatctggcggaggacagatctacgagggcaagctgacagccgagggcctgagatttggaatcgtggccagccggttcaatcacgccctggtggatagactggtggaaggcgccatcgatgccattgtcagacacggcggcagagaagaggacatcaccctcgttagagtgcccggctcttgggagattcctgtggctgctggcgagctggcccggaaagaagatatcgacgccgttatcgccatcggcgtgctgatcagaggcgccacacctcacttcgactatatcgccagcgaggtgtccaaaggcctggccgatctgagcctggaactgagaaagcccatcaccttcggcgtgatcaccgctgacacactggaacaggccattgagagagccggcaccaagcacggcaacaaaggatgggaagccgctctgtccgccatcgagatggccaacctgttcaagagcctgcggtga

SEQ ID NO: 12090 - RNA, 4116 nt, synthetic construct
  misc_feature 1..4116: note = SARS-CoV-2/Wuhan/WIV05/2019__EPI_ISL_402128 spike protein CDS gc mod (1-1211)(I714C_Y1110C) LumSynth construct
  source 1..4116: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgcttgccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctgtgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggcggaggatctggcggaggacagatctacgagggcaagctgacagccgagggcctgagatttggaatcgtggccagccggttcaatcacgccctggtggatagactggtggaaggcgccatcgatgccattgtcagacacggcggcagagaagaggacatcaccctcgttagagtgcccggctcttgggagattcctgtggctgctggcgagctggcccggaaagaagatatcgacgccgttatcgccatcggcgtgctgatcagaggcgccacacctcacttcgactatatcgccagcgaggtgtccaaaggcctggccgatctgagcctggaactgagaaagcccatcaccttcggcgtgatcaccgctgacacactggaacaggccattgagagagccggcaccaagcacggcaacaaaggatgggaagccgctctgtccgccatcgagatggccaacctgttcaagagcctgcggtga

SEQ ID NO: 12091 - RNA, 4116 nt, synthetic construct
  misc_feature 1..4116: note = SARS-CoV-2/Wuhan/WIV05/2019__EPI_ISL_402128 spike protein CDS gc mod (1-1211)(P715C_P1069C) LumSynth construct
  source 1..4116: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatctgcaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgtgtgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggcggaggatctggcggaggacagatctacgagggcaagctgacagccgagggcctgagatttggaatcgtggccagccggttcaatcacgccctggtggatagactggtggaaggcgccatcgatgccattgtcagacacggcggcagagaagaggacatcaccctcgttagagtgcccggctcttgggagattcctgtggctgctggcgagctggcccggaaagaagatatcgacgccgttatcgccatcggcgtgctgatcagaggcgccacacctcacttcgactatatcgccagcgaggtgtccaaaggcctggccgatctgagcctggaactgagaaagcccatcaccttcggcgtgatcaccgctgacacactggaacaggccattgagagagccggcaccaagcacggcaacaaaggatgggaagccgctctgtccgccatcgagatggccaacctgttcaagagcctgcggtga

SEQ ID NO: 12092 - RNA, 4116 nt, synthetic construct
  misc_feature 1..4116: note = SARS-CoV-2/Wuhan/WIV05/2019__EPI_ISL_402128 spike protein CDS gc mod (1-1211)(G889C_L1034C) LumSynth construct
  source 1..4116: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacattttgcgctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgtgtggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggcggaggatctggcggaggacagatctacgagggcaagctgacagccgagggcctgagatttggaatcgtggccagccggttcaatcacgccctggtggatagactggtggaaggcgccatcgatgccattgtcagacacggcggcagagaagaggacatcaccctcgttagagtgcccggctcttgggagattcctgtggctgctggcgagctggcccggaaagaagatatcgacgccgttatcgccatcggcgtgctgatcagaggcgccacacctcacttcgactatatcgccagcgaggtgtccaaaggcctggccgatctgagcctggaactgagaaagcccatcaccttcggcgtgatcaccgctgacacactggaacaggccattgagagagccggcaccaagcacggcaacaaaggatgggaagccgctctgtccgccatcgagatggccaacctgttcaagagcctgcggtga

SEQ ID NO: 12093 - RNA, 4116 nt, synthetic construct
  misc_feature 1..4116: note = SARS-CoV-2/Wuhan/WIV05/2019__EPI_ISL_402128 spike protein CDS gc mod (1-1211)(I909C_Y1047C) LumSynth construct
  source 1..4116: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggctgcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctgtcacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggcggaggatctggcggaggacagatctacgagggcaagctgacagccgagggcctgagatttggaatcgtggccagccggttcaatcacgccctggtggatagactggtggaaggcgccatcgatgccattgtcagacacggcggcagagaagaggacatcaccctcgttagagtgcccggctcttgggagattcctgtggctgctggcgagctggcccggaaagaagatatcgacgccgttatcgccatcggcgtgctgatcagaggcgccacacctcacttcgactatatcgccagcgaggtgtccaaaggcctggccgatctgagcctggaactgagaaagcccatcaccttcggcgtgatcaccgctgacacactggaacaggccattgagagagccggcaccaagcacggcaacaaaggatgggaagccgctctgtccgccatcgagatggccaacctgttcaagagcctgcggtga

SEQ ID NO: 12094 - RNA, 4116 nt, synthetic construct
  misc_feature 1..4116: note = SARS-CoV-2/Wuhan/WIV05/2019__EPI_ISL_402128 spike protein CDS gc mod (1-1211)(Q965C_S1003C) LumSynth construct
  source 1..4116: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagtgcctgtcctccaacttcggcgccatcagctctgtgctgaacgatatcctgagcagactggacaaggtcgaggccgaggtgcagatcgacagactgatcacaggcagactgcagtgtctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggcggaggatctggcggaggacagatctacgagggcaagctgacagccgagggcctgagatttggaatcgtggccagccggttcaatcacgccctggtggatagactggtggaaggcgccatcgatgccattgtcagacacggcggcagagaagaggacatcaccctcgttagagtgcccggctcttgggagattcctgtggctgctggcgagctggcccggaaagaagatatcgacgccgttatcgccatcggcgtgctgatcagaggcgccacacctcacttcgactatatcgccagcgaggtgtccaaaggcctggccgatctgagcctggaactgagaaagcccatcaccttcggcgtgatcaccgctgacacactggaacaggccattgagagagccggcaccaagcacggcaacaaaggatgggaagccgctctgtccgccatcgagatggccaacctgttcaagagcctgcggtga

SEQ ID NO: 12095 - RNA, 4116 nt, synthetic construct
  misc_feature 1..4116: note = SARS-CoV-2/Wuhan/WIV05/2019__EPI_ISL_402128 spike protein CDS gc mod (1-1211)(F970C_G999C) LumSynth construct
  source 1..4116: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaactgcggcgccatcagctctgtgctgaacgatatcctgagcagactggacaaggtcgaggccgaggtgcagatcgacagactgatcacatgtagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggcggaggatctggcggaggacagatctacgagggcaagctgacagccgagggcctgagatttggaatcgtggccagccggttcaatcacgccctggtggatagactggtggaaggcgccatcgatgccattgtcagacacggcggcagagaagaggacatcaccctcgttagagtgcccggctcttgggagattcctgtggctgctggcgagctggcccggaaagaagatatcgacgccgttatcgccatcggcgtgctgatcagaggcgccacacctcacttcgactatatcgccagcgaggtgtccaaaggcctggccgatctgagcctggaactgagaaagcccatcaccttcggcgtgatcaccgctgacacactggaacaggccattgagagagccggcaccaagcacggcaacaaaggatgggaagccgctctgtccgccatcgagatggccaacctgttcaagagcctgcggtga

SEQ ID NO: 12096 - RNA, 4116 nt, synthetic construct
  misc_feature 1..4116: note = SARS-CoV-2/Wuhan/WIV05/2019__EPI_ISL_402128 spike protein CDS gc mod (1-1211)(A972C_R995C) LumSynth construct
  source 1..4116: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggctgcatcagctctgtgctgaacgatatcctgagcagactggacaaggtcgaggccgaggtgcagatcgactgtctgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggcggaggatctggcggaggacagatctacgagggcaagctgacagccgagggcctgagatttggaatcgtggccagccggttcaatcacgccctggtggatagactggtggaaggcgccatcgatgccattgtcagacacggcggcagagaagaggacatcaccctcgttagagtgcccggctcttgggagattcctgtggctgctggcgagctggcccggaaagaagatatcgacgccgttatcgccatcggcgtgctgatcagaggcgccacacctcacttcgactatatcgccagcgaggtgtccaaaggcctggccgatctgagcctggaactgagaaagcccatcaccttcggcgtgatcaccgctgacacactggaacaggccattgagagagccggcaccaagcacggcaacaaaggatgggaagccgctctgtccgccatcgagatggccaacctgttcaagagcctgcggtga

SEQ ID NO: 12097 - RNA, 4116 nt, synthetic construct
  misc_feature 1..4116: note = SARS-CoV-2/Wuhan/WIV05/2019__EPI_ISL_402128 spike protein CDS gc mod (1-1211)(A890C_V1040C) LumSynth construct
  source 1..4116: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggatgcggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagatgtgacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggcggaggatctggcggaggacagatctacgagggcaagctgacagccgagggcctgagatttggaatcgtggccagccggttcaatcacgccctggtggatagactggtggaaggcgccatcgatgccattgtcagacacggcggcagagaagaggacatcaccctcgttagagtgcccggctcttgggagattcctgtggctgctggcgagctggcccggaaagaagatatcgacgccgttatcgccatcggcgtgctgatcagaggcgccacacctcacttcgactatatcgccagcgaggtgtccaaaggcctggccgatctgagcctggaactgagaaagcccatcaccttcggcgtgatcaccgctgacacactggaacaggccattgagagagccggcaccaagcacggcaacaaaggatgggaagccgctctgtccgccatcgagatggccaacctgttcaagagcctgcggtga

SEQ ID NO: 12098 - RNA, 4116 nt, synthetic construct
  misc_feature 1..4116: note = SARS-CoV-2/Wuhan/WIV05/2019__EPI_ISL_402128 spike protein CDS gc mod (1-1211)(T874C_S1055C) LumSynth construct
  source 1..4116: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtactgctctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtgcgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggcggaggatctggcggaggacagatctacgagggcaagctgacagccgagggcctgagatttggaatcgtggccagccggttcaatcacgccctggtggatagactggtggaaggcgccatcgatgccattgtcagacacggcggcagagaagaggacatcaccctcgttagagtgcccggctcttgggagattcctgtggctgctggcgagctggcccggaaagaagatatcgacgccgttatcgccatcggcgtgctgatcagaggcgccacacctcacttcgactatatcgccagcgaggtgtccaaaggcctggccgatctgagcctggaactgagaaagcccatcaccttcggcgtgatcaccgctgacacactggaacaggccattgagagagccggcaccaagcacggcaacaaaggatgggaagccgctctgtccgccatcgagatggccaacctgttcaagagcctgcggtga

SEQ ID NO: 12099 - RNA, 4140 nt, synthetic construct
  misc_feature 1..4140: note = SARS-CoV-2/Wuhan/WIV05/2019__EPI_ISL_402128 spike protein CDS gc mod (1-1211) Ferritin construct
  source 1..4140: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggaggcggaggatctgacatcatcaagctgctgaacgagcaagtgaacaaagagatgcagagcagcaacctgtacatgagcatgagcagctggtgctacacccacagccttgatggcgccggactgttcctgtttgatcacgccgccgaggaatacgagcacgccaagaagctgatcatcttcctgaacgagaacaacgtgcccgtgcagctgaccagcatttctgcccctgagcacaagttcgagggcctgacacagatcttccagaaggcctacgaacacgagcagcacatcagcgagagcatcaacaacatcgtggaccacgccattaagagcaaggatcacgccaccttcaactttctgcagtggtacgtggccgaacagcacgaggaagaggtgctgttcaaggacatcctggacaagatcgagctgatcggcaacgagaaccacggcctgtatctggccgaccagtacgtgaagggaatcgccaagagcagaaagagctga

SEQ ID NO: 12100 - RNA, 4140 nt, synthetic construct
  misc_feature 1..4140: note = SARS-CoV-2/Wuhan/WIV05/2019__EPI_ISL_402128 spike protein CDS gc mod (1-1211)(K986P_V987P) Ferritin construct
  source 1..4140: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggaggcggaggatctgacatcatcaagctgctgaacgagcaagtgaacaaagagatgcagagcagcaacctgtacatgagcatgagcagctggtgctacacccacagccttgatggcgccggactgttcctgtttgatcacgccgccgaggaatacgagcacgccaagaagctgatcatcttcctgaacgagaacaacgtgcccgtgcagctgaccagcatttctgcccctgagcacaagttcgagggcctgacacagatcttccagaaggcctacgaacacgagcagcacatcagcgagagcatcaacaacatcgtggaccacgccattaagagcaaggatcacgccaccttcaactttctgcagtggtacgtggccgaacagcacgaggaagaggtgctgttcaaggacatcctggacaagatcgagctgatcggcaacgagaaccacggcctgtatctggccgaccagtacgtgaagggaatcgccaagagcagaaagagctga

SEQ ID NO: 12101 - RNA, 4140 nt, synthetic construct
  misc_feature 1..4140: note = SARS-CoV-2/Wuhan/WIV05/2019__EPI_ISL_402128 spike protein CDS gc mod (1-1211)(K986P_V987P_T887WN_A1020W) Ferritin construct
  source 1..4140: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggtggtttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagatggtctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggaggcggaggatctgacatcatcaagctgctgaacgagcaagtgaacaaagagatgcagagcagcaacctgtacatgagcatgagcagctggtgctacacccacagccttgatggcgccggactgttcctgtttgatcacgccgccgaggaatacgagcacgccaagaagctgatcatcttcctgaacgagaacaacgtgcccgtgcagctgaccagcatttctgcccctgagcacaagttcgagggcctgacacagatcttccagaaggcctacgaacacgagcagcacatcagcgagagcatcaacaacatcgtggaccacgccattaagagcaaggatcacgccaccttcaactttctgcagtggtacgtggccgaacagcacgaggaagaggtgctgttcaaggacatcctggacaagatcgagctgatcggcaacgagaaccacggcctgtatctggccgaccagtacgtgaagggaatcgccaagagcagaaagagctga

SEQ ID NO: 12102 - RNA, 4140 nt, synthetic construct
  misc_feature 1..4140: note = SARS-CoV-2/Wuhan/WIV05/2019__EPI_ISL_402128 spike protein CDS gc mod (1-1211)(K986P_V987P_P1069F) Ferritin construct
  source 1..4140: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgttcgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggaggcggaggatctgacatcatcaagctgctgaacgagcaagtgaacaaagagatgcagagcagcaacctgtacatgagcatgagcagctggtgctacacccacagccttgatggcgccggactgttcctgtttgatcacgccgccgaggaatacgagcacgccaagaagctgatcatcttcctgaacgagaacaacgtgcccgtgcagctgaccagcatttctgcccctgagcacaagttcgagggcctgacacagatcttccagaaggcctacgaacacgagcagcacatcagcgagagcatcaacaacatcgtggaccacgccattaagagcaaggatcacgccaccttcaactttctgcagtggtacgtggccgaacagcacgaggaagaggtgctgttcaaggacatcctggacaagatcgagctgatcggcaacgagaaccacggcctgtatctggccgaccagtacgtgaagggaatcgccaagagcagaaagagctga

SEQ ID NO: 12103 - RNA, 4140 nt, synthetic construct
  misc_feature 1..4140: note = SARS-CoV-2/Wuhan/WIV05/2019__EPI_ISL_402128 spike protein CDS gc mod (1-1211)(K986P_V987P_ H1048Q_H1064N_ H1083N_H1101N) Ferritin construct
  source 1..4140: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccagctgatgagcttccctcagtctgcccctcacggcgtggtgtttctgaacgtgacatatgtgcccgctcaagagaagaatttcaccaccgctccagccatctgcaacgacggcaaagcccactttcctagagaaggcgtgttcgtgtccaacggcaccaactggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggaggcggaggatctgacatcatcaagctgctgaacgagcaagtgaacaaagagatgcagagcagcaacctgtacatgagcatgagcagctggtgctacacccacagccttgatggcgccggactgttcctgtttgatcacgccgccgaggaatacgagcacgccaagaagctgatcatcttcctgaacgagaacaacgtgcccgtgcagctgaccagcatttctgcccctgagcacaagttcgagggcctgacacagatcttccagaaggcctacgaacacgagcagcacatcagcgagagcatcaacaacatcgtggaccacgccattaagagcaaggatcacgccaccttcaactttctgcagtggtacgtggccgaacagcacgaggaagaggtgctgttcaaggacatcctggacaagatcgagctgatcggcaacgagaaccacggcctgtatctggccgaccagtacgtgaagggaatcgccaagagcagaaagagctga

SEQ ID NO: 12104 - RNA, 4140 nt, synthetic construct
  misc_feature 1..4140: note = SARS-CoV-2/Wuhan/WIV05/2019__EPI_ISL_402128 spike protein CDS gc mod (1-1211)(I712C_T1077C) Ferritin construct
  source 1..4140: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactcttgcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcacctgtgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggaggcggaggatctgacatcatcaagctgctgaacgagcaagtgaacaaagagatgcagagcagcaacctgtacatgagcatgagcagctggtgctacacccacagccttgatggcgccggactgttcctgtttgatcacgccgccgaggaatacgagcacgccaagaagctgatcatcttcctgaacgagaacaacgtgcccgtgcagctgaccagcatttctgcccctgagcacaagttcgagggcctgacacagatcttccagaaggcctacgaacacgagcagcacatcagcgagagcatcaacaacatcgtggaccacgccattaagagcaaggatcacgccaccttcaactttctgcagtggtacgtggccgaacagcacgaggaagaggtgctgttcaaggacatcctggacaagatcgagctgatcggcaacgagaaccacggcctgtatctggccgaccagtacgtgaagggaatcgccaagagcagaaagagctga

SEQ ID NO: 12105 - RNA, 4140 nt, synthetic construct
  misc_feature 1..4140: note = SARS-CoV-2/Wuhan/WIV05/2019__EPI_ISL_402128 spike protein CDS gc mod (1-1211)(I714C_Y1110C) Ferritin construct
  source 1..4140: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgcttgccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctgtgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggaggcggaggatctgacatcatcaagctgctgaacgagcaagtgaacaaagagatgcagagcagcaacctgtacatgagcatgagcagctggtgctacacccacagccttgatggcgccggactgttcctgtttgatcacgccgccgaggaatacgagcacgccaagaagctgatcatcttcctgaacgagaacaacgtgcccgtgcagctgaccagcatttctgcccctgagcacaagttcgagggcctgacacagatcttccagaaggcctacgaacacgagcagcacatcagcgagagcatcaacaacatcgtggaccacgccattaagagcaaggatcacgccaccttcaactttctgcagtggtacgtggccgaacagcacgaggaagaggtgctgttcaaggacatcctggacaagatcgagctgatcggcaacgagaaccacggcctgtatctggccgaccagtacgtgaagggaatcgccaagagcagaaagagctga

SEQ ID NO: 12106 - RNA, 4140 nt, synthetic construct
  misc_feature 1..4140: note = SARS-CoV-2/Wuhan/WIV05/2019__EPI_ISL_402128 spike protein CDS gc mod (1-1211)(P715C_P1069C) Ferritin construct
  source 1..4140: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatctgcaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgtgtgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggaggcggaggatctgacatcatcaagctgctgaacgagcaagtgaacaaagagatgcagagcagcaacctgtacatgagcatgagcagctggtgctacacccacagccttgatggcgccggactgttcctgtttgatcacgccgccgaggaatacgagcacgccaagaagctgatcatcttcctgaacgagaacaacgtgcccgtgcagctgaccagcatttctgcccctgagcacaagttcgagggcctgacacagatcttccagaaggcctacgaacacgagcagcacatcagcgagagcatcaacaacatcgtggaccacgccattaagagcaaggatcacgccaccttcaactttctgcagtggtacgtggccgaacagcacgaggaagaggtgctgttcaaggacatcctggacaagatcgagctgatcggcaacgagaaccacggcctgtatctggccgaccagtacgtgaagggaatcgccaagagcagaaagagctga

SEQ ID NO: 12107 - RNA, 4140 nt, synthetic construct
  misc_feature 1..4140: note = SARS-CoV-2/Wuhan/WIV05/2019__EPI_ISL_402128 spike protein CDS gc mod (1-1211)(G889C_L1034C) Ferritin construct
  source 1..4140: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacattttgcgctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgtgtggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggaggcggaggatctgacatcatcaagctgctgaacgagcaagtgaacaaagagatgcagagcagcaacctgtacatgagcatgagcagctggtgctacacccacagccttgatggcgccggactgttcctgtttgatcacgccgccgaggaatacgagcacgccaagaagctgatcatcttcctgaacgagaacaacgtgcccgtgcagctgaccagcatttctgcccctgagcacaagttcgagggcctgacacagatcttccagaaggcctacgaacacgagcagcacatcagcgagagcatcaacaacatcgtggaccacgccattaagagcaaggatcacgccaccttcaactttctgcagtggtacgtggccgaacagcacgaggaagaggtgctgttcaaggacatcctggacaagatcgagctgatcggcaacgagaaccacggcctgtatctggccgaccagtacgtgaagggaatcgccaagagcagaaagagctga

SEQ ID NO: 12108 - RNA, 4140 nt, synthetic construct
  misc_feature 1..4140: note = SARS-CoV-2/Wuhan/WIV05/2019__EPI_ISL_402128 spike protein CDS gc mod (1-1211)(I909C_Y1047C) Ferritin construct
  source 1..4140: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggctgcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctgtcacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggaggcggaggatctgacatcatcaagctgctgaacgagcaagtgaacaaagagatgcagagcagcaacctgtacatgagcatgagcagctggtgctacacccacagccttgatggcgccggactgttcctgtttgatcacgccgccgaggaatacgagcacgccaagaagctgatcatcttcctgaacgagaacaacgtgcccgtgcagctgaccagcatttctgcccctgagcacaagttcgagggcctgacacagatcttccagaaggcctacgaacacgagcagcacatcagcgagagcatcaacaacatcgtggaccacgccattaagagcaaggatcacgccaccttcaactttctgcagtggtacgtggccgaacagcacgaggaagaggtgctgttcaaggacatcctggacaagatcgagctgatcggcaacgagaaccacggcctgtatctggccgaccagtacgtgaagggaatcgccaagagcagaaagagctga

SEQ ID NO: 12109 - RNA, 4140 nt, synthetic construct
  misc_feature 1..4140: note = SARS-CoV-2/Wuhan/WIV05/2019__EPI_ISL_402128 spike protein CDS gc mod (1-1211)(Q965C_S1003C) Ferritin construct
  source 1..4140: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagtgcctgtcctccaacttcggcgccatcagctctgtgctgaacgatatcctgagcagactggacaaggtcgaggccgaggtgcagatcgacagactgatcacaggcagactgcagtgtctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggaggcggaggatctgacatcatcaagctgctgaacgagcaagtgaacaaagagatgcagagcagcaacctgtacatgagcatgagcagctggtgctacacccacagccttgatggcgccggactgttcctgtttgatcacgccgccgaggaatacgagcacgccaagaagctgatcatcttcctgaacgagaacaacgtgcccgtgcagctgaccagcatttctgcccctgagcacaagttcgagggcctgacacagatcttccagaaggcctacgaacacgagcagcacatcagcgagagcatcaacaacatcgtggaccacgccattaagagcaaggatcacgccaccttcaactttctgcagtggtacgtggccgaacagcacgaggaagaggtgctgttcaaggacatcctggacaagatcgagctgatcggcaacgagaaccacggcctgtatctggccgaccagtacgtgaagggaatcgccaagagcagaaagagctga

SEQ ID NO: 12110 - RNA, 4140 nt, synthetic construct
  misc_feature 1..4140: note = SARS-CoV-2/Wuhan/WIV05/2019__EPI_ISL_402128 spike protein CDS gc mod (1-1211)(F970C_G999C) Ferritin construct
  source 1..4140: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaactgcggcgccatcagctctgtgctgaacgatatcctgagcagactggacaaggtcgaggccgaggtgcagatcgacagactgatcacatgtagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggaggcggaggatctgacatcatcaagctgctgaacgagcaagtgaacaaagagatgcagagcagcaacctgtacatgagcatgagcagctggtgctacacccacagccttgatggcgccggactgttcctgtttgatcacgccgccgaggaatacgagcacgccaagaagctgatcatcttcctgaacgagaacaacgtgcccgtgcagctgaccagcatttctgcccctgagcacaagttcgagggcctgacacagatcttccagaaggcctacgaacacgagcagcacatcagcgagagcatcaacaacatcgtggaccacgccattaagagcaaggatcacgccaccttcaactttctgcagtggtacgtggccgaacagcacgaggaagaggtgctgttcaaggacatcctggacaagatcgagctgatcggcaacgagaaccacggcctgtatctggccgaccagtacgtgaagggaatcgccaagagcagaaagagctga

SEQ ID NO: 12111 - RNA, 4140 nt, synthetic construct
  misc_feature 1..4140: note = SARS-CoV-2/Wuhan/WIV05/2019__EPI_ISL_402128 spike protein CDS gc mod (1-1211)(A972C_R995C) Ferritin construct
  source 1..4140: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggctgcatcagctctgtgctgaacgatatcctgagcagactggacaaggtcgaggccgaggtgcagatcgactgtctgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggaggcggaggatctgacatcatcaagctgctgaacgagcaagtgaacaaagagatgcagagcagcaacctgtacatgagcatgagcagctggtgctacacccacagccttgatggcgccggactgttcctgtttgatcacgccgccgaggaatacgagcacgccaagaagctgatcatcttcctgaacgagaacaacgtgcccgtgcagctgaccagcatttctgcccctgagcacaagttcgagggcctgacacagatcttccagaaggcctacgaacacgagcagcacatcagcgagagcatcaacaacatcgtggaccacgccattaagagcaaggatcacgccaccttcaactttctgcagtggtacgtggccgaacagcacgaggaagaggtgctgttcaaggacatcctggacaagatcgagctgatcggcaacgagaaccacggcctgtatctggccgaccagtacgtgaagggaatcgccaagagcagaaagagctga

SEQ ID NO: 12112 - RNA, 4140 nt, synthetic construct
  misc_feature 1..4140: note = SARS-CoV-2/Wuhan/WIV05/2019__EPI_ISL_402128 spike protein CDS gc mod (1-1211)(A890C_V1040C) Ferritin construct
  source 1..4140: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggatgcggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagatgtgacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggaggcggaggatctgacatcatcaagctgctgaacgagcaagtgaacaaagagatgcagagcagcaacctgtacatgagcatgagcagctggtgctacacccacagccttgatggcgccggactgttcctgtttgatcacgccgccgaggaatacgagcacgccaagaagctgatcatcttcctgaacgagaacaacgtgcccgtgcagctgaccagcatttctgcccctgagcacaagttcgagggcctgacacagatcttccagaaggcctacgaacacgagcagcacatcagcgagagcatcaacaacatcgtggaccacgccattaagagcaaggatcacgccaccttcaactttctgcagtggtacgtggccgaacagcacgaggaagaggtgctgttcaaggacatcctggacaagatcgagctgatcggcaacgagaaccacggcctgtatctggccgaccagtacgtgaagggaatcgccaagagcagaaagagctga

SEQ ID NO: 12113 - RNA, 4140 nt, synthetic construct
  misc_feature 1..4140: note = SARS-CoV-2/Wuhan/WIV05/2019__EPI_ISL_402128 spike protein CDS gc mod (1-1211)(T874C_S1055C) Ferritin construct
  source 1..4140: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtactgctctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtgcgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggaggcggaggatctgacatcatcaagctgctgaacgagcaagtgaacaaagagatgcagagcagcaacctgtacatgagcatgagcagctggtgctacacccacagccttgatggcgccggactgttcctgtttgatcacgccgccgaggaatacgagcacgccaagaagctgatcatcttcctgaacgagaacaacgtgcccgtgcagctgaccagcatttctgcccctgagcacaagttcgagggcctgacacagatcttccagaaggcctacgaacacgagcagcacatcagcgagagcatcaacaacatcgtggaccacgccattaagagcaaggatcacgccaccttcaactttctgcagtggtacgtggccgaacagcacgaggaagaggtgctgttcaaggacatcctggacaagatcgagctgatcggcaacgagaaccacggcctgtatctggccgaccagtacgtgaagggaatcgccaagagcagaaagagctga

SEQ ID NO: 12114 - RNA, 3726 nt, synthetic construct
  misc_feature 1..3726: note = SARS-CoV-2/Wuhan/WIV05/2019__EPI_ISL_402128 spike protein CDS gc mod (1-1211) Foldon construct
  source 1..3726: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggaggatctggctatatccccgaggctcctagagatggccaggcctatgttcggaaggatggcgaatgggtgctgctgagcaccttcctttga

SEQ ID NO: 12115 - RNA, 3726 nt, synthetic construct
  misc_feature 1..3726: note = SARS-CoV-2/Wuhan/WIV05/2019__EPI_ISL_402128 spike protein CDS gc mod (1-1211)(K986P_V987P) Foldon construct
  source 1..3726: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggaggatctggctatatccccgaggctcctagagatggccaggcctatgttcggaaggatggcgaatgggtgctgctgagcaccttcctttga

SEQ ID NO: 12116 - RNA, 3726 nt, synthetic construct
  misc_feature 1..3726: note = SARS-CoV-2/Wuhan/WIV05/2019__EPI_ISL_402128 spike protein CDS gc mod (1-1211)(K986P_V987P_T887WN_A1020W) Foldon construct
  source 1..3726: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggtggtttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagatggtctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggaggatctggctatatccccgaggctcctagagatggccaggcctatgttcggaaggatggcgaatgggtgctgctgagcaccttcctttga

SEQ ID NO: 12117 - RNA, 3726 nt, synthetic construct
  misc_feature 1..3726: note = SARS-CoV-2/Wuhan/WIV05/2019__EPI_ISL_402128 spike protein CDS gc mod (1-1211)(K986P_V987P_P1069F) Foldon construct
  source 1..3726: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgttcgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggaggatctggctatatccccgaggctcctagagatggccaggcctatgttcggaaggatggcgaatgggtgctgctgagcaccttcctttga

SEQ ID NO: 12118 - RNA, 3726 nt, synthetic construct
  misc_feature 1..3726: note = SARS-CoV-2/Wuhan/WIV05/2019__EPI_ISL_402128 spike protein CDS gc mod (1-1211)(K986P_V987P_ H1048Q_H1064N_ H1083N_H1101N) Foldon construct
  source 1..3726: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccagctgatgagcttccctcagtctgcccctcacggcgtggtgtttctgaacgtgacatatgtgcccgctcaagagaagaatttcaccaccgctccagccatctgcaacgacggcaaagcccactttcctagagaaggcgtgttcgtgtccaacggcaccaactggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggaggatctggctatatccccgaggctcctagagatggccaggcctatgttcggaaggatggcgaatgggtgctgctgagcaccttcctttga

SEQ ID NO: 12119 - RNA, 3726 nt, synthetic construct
  misc_feature 1..3726: note = SARS-CoV-2/Wuhan/WIV05/2019__EPI_ISL_402128 spike protein CDS gc mod (1-1211)(I712C_T1077C) Foldon construct
  source 1..3726: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactcttgcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcacctgtgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggaggatctggctatatccccgaggctcctagagatggccaggcctatgttcggaaggatggcgaatgggtgctgctgagcaccttcctttga

SEQ ID NO: 12120 - RNA, 3726 nt, synthetic construct
  misc_feature 1..3726: note = SARS-CoV-2/Wuhan/WIV05/2019__EPI_ISL_402128 spike protein CDS gc mod (1-1211)(I714C_Y1110C) Foldon construct
  source 1..3726: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgcttgccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctgtgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggaggatctggctatatccccgaggctcctagagatggccaggcctatgttcggaaggatggcgaatgggtgctgctgagcaccttcctttga

SEQ ID NO: 12121 - RNA, 3726 nt, synthetic construct
  misc_feature 1..3726: note = SARS-CoV-2/Wuhan/WIV05/2019__EPI_ISL_402128 spike protein CDS gc mod (1-1211)(P715C_P1069C) Foldon construct
  source 1..3726: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatctgcaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgtgtgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggaggatctggctatatccccgaggctcctagagatggccaggcctatgttcggaaggatggcgaatgggtgctgctgagcaccttcctttga

SEQ ID NO: 12122 - RNA, 3726 nt, synthetic construct
  misc_feature 1..3726: note = SARS-CoV-2/Wuhan/WIV05/2019__EPI_ISL_402128 spike protein CDS gc mod (1-1211)(G889C_L1034C) Foldon construct
  source 1..3726: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacattttgcgctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgtgtggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggaggatctggctatatccccgaggctcctagagatggccaggcctatgttcggaaggatggcgaatgggtgctgctgagcaccttcctttga

SEQ ID NO: 12123 - RNA, 3726 nt, synthetic construct
  misc_feature 1..3726: note = SARS-CoV-2/Wuhan/WIV05/2019__EPI_ISL_402128 spike protein CDS gc mod (1-1211)(I909C_Y1047C) Foldon construct
  source 1..3726: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggctgcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctgtcacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggaggatctggctatatccccgaggctcctagagatggccaggcctatgttcggaaggatggcgaatgggtgctgctgagcaccttcctttga

SEQ ID NO: 12124 - RNA, 3726 nt, synthetic construct
  misc_feature 1..3726: note = SARS-CoV-2/Wuhan/WIV05/2019__EPI_ISL_402128 spike protein CDS gc mod (1-1211)(Q965C_S1003C) Foldon construct
  source 1..3726: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagtgcctgtcctccaacttcggcgccatcagctctgtgctgaacgatatcctgagcagactggacaaggtcgaggccgaggtgcagatcgacagactgatcacaggcagactgcagtgtctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggaggatctggctatatccccgaggctcctagagatggccaggcctatgttcggaaggatggcgaatgggtgctgctgagcaccttcctttga

SEQ ID NO: 12125 - RNA, 3726 nt, synthetic construct
  misc_feature 1..3726: note = SARS-CoV-2/Wuhan/WIV05/2019__EPI_ISL_402128 spike protein CDS gc mod (1-1211)(F970C_G999C) Foldon construct
  source 1..3726: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaactgcggcgccatcagctctgtgctgaacgatatcctgagcagactggacaaggtcgaggccgaggtgcagatcgacagactgatcacatgtagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggaggatctggctatatccccgaggctcctagagatggccaggcctatgttcggaaggatggcgaatgggtgctgctgagcaccttcctttga

SEQ ID NO: 12126 - RNA, 3726 nt, synthetic construct
  misc_feature 1..3726: note = SARS-CoV-2/Wuhan/WIV05/2019__EPI_ISL_402128 spike protein CDS gc mod (1-1211)(A972C_R995C) Foldon construct
  source 1..3726: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggctgcatcagctctgtgctgaacgatatcctgagcagactggacaaggtcgaggccgaggtgcagatcgactgtctgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggaggatctggctatatccccgaggctcctagagatggccaggcctatgttcggaaggatggcgaatgggtgctgctgagcaccttcctttga

SEQ ID NO: 12127 - RNA, 3726 nt, synthetic construct
  misc_feature 1..3726: note = SARS-CoV-2/Wuhan/WIV05/2019__EPI_ISL_402128 spike protein CDS gc mod (1-1211)(A890C_V1040C) Foldon construct
  source 1..3726: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggatgcggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagatgtgacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggaggatctggctatatccccgaggctcctagagatggccaggcctatgttcggaaggatggcgaatgggtgctgctgagcaccttcctttga

SEQ ID NO: 12128 - RNA, 3726 nt, synthetic construct
  misc_feature 1..3726: note = SARS-CoV-2/Wuhan/WIV05/2019__EPI_ISL_402128 spike protein CDS gc mod (1-1211)(T874C_S1055C) Foldon construct
  source 1..3726: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtactgctctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtgcgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggaggatctggctatatccccgaggctcctagagatggccaggcctatgttcggaaggatggcgaatgggtgctgctgagcaccttcctttga

SEQ ID NO: 12129 - RNA, 4098 nt, synthetic construct
  misc_feature 1..4098: note = SARS-CoV-2/Wuhan/WIV05/2019__EPI_ISL_402128 spike protein CDS gc mod (1-1211) WhcAg construct
  source 1..4098: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggaggcggaggatctgacatcgacccctacaaagagttcggcagcagctaccagctgctgaacttcctgcctctggacttcttccccgacctgaacgccctggtggatacagccacagctctgtacgaggaagaactgaccggcagagagcactgcagccctcaccacacagccattagacaggccctcgtgtgctgggacgagctgacaaaactgatcgcctggatgagcagcaacatcaccagcgagcaagtgcggaccatcatcgtgaaccacgtgaacgatacctggggcctgaaagtgcggcagagcctgtggtttcacctgagctgtctgaccttcggccagcacaccgtgcaagagtttctggtgtccttcggcgtgtggatcagaacccctgctccatacagacctccaaacgctcccatcctgagcaccctgcctgagcacacagtgatctgttga

SEQ ID NO: 12130 - RNA, 4098 nt, synthetic construct
  misc_feature 1..4098: note = SARS-CoV-2/Wuhan/WIV05/2019__EPI_ISL_402128 spike protein CDS gc mod (1-1211)(K986P_V987P) WhcAg construct
  source 1..4098: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggaggcggaggatctgacatcgacccctacaaagagttcggcagcagctaccagctgctgaacttcctgcctctggacttcttccccgacctgaacgccctggtggatacagccacagctctgtacgaggaagaactgaccggcagagagcactgcagccctcaccacacagccattagacaggccctcgtgtgctgggacgagctgacaaaactgatcgcctggatgagcagcaacatcaccagcgagcaagtgcggaccatcatcgtgaaccacgtgaacgatacctggggcctgaaagtgcggcagagcctgtggtttcacctgagctgtctgaccttcggccagcacaccgtgcaagagtttctggtgtccttcggcgtgtggatcagaacccctgctccatacagacctccaaacgctcccatcctgagcaccctgcctgagcacacagtgatctgttga

SEQ ID NO: 12131 - RNA, 4098 nt, synthetic construct
  misc_feature 1..4098: note = SARS-CoV-2/Wuhan/WIV05/2019__EPI_ISL_402128 spike protein CDS gc mod (1-1211)(K986P_V987P_T887WN_A1020W) WhcAg construct
  source 1..4098: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggtggtttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagatggtctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggaggcggaggatctgacatcgacccctacaaagagttcggcagcagctaccagctgctgaacttcctgcctctggacttcttccccgacctgaacgccctggtggatacagccacagctctgtacgaggaagaactgaccggcagagagcactgcagccctcaccacacagccattagacaggccctcgtgtgctgggacgagctgacaaaactgatcgcctggatgagcagcaacatcaccagcgagcaagtgcggaccatcatcgtgaaccacgtgaacgatacctggggcctgaaagtgcggcagagcctgtggtttcacctgagctgtctgaccttcggccagcacaccgtgcaagagtttctggtgtccttcggcgtgtggatcagaacccctgctccatacagacctccaaacgctcccatcctgagcaccctgcctgagcacacagtgatctgttga

SEQ ID NO: 12132 - RNA, 4098 nt, synthetic construct
  misc_feature 1..4098: note = SARS-CoV-2/Wuhan/WIV05/2019__EPI_ISL_402128 spike protein CDS gc mod (1-1211)(K986P_V987P_P1069F) WhcAg construct
  source 1..4098: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgttcgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggaggcggaggatctgacatcgacccctacaaagagttcggcagcagctaccagctgctgaacttcctgcctctggacttcttccccgacctgaacgccctggtggatacagccacagctctgtacgaggaagaactgaccggcagagagcactgcagccctcaccacacagccattagacaggccctcgtgtgctgggacgagctgacaaaactgatcgcctggatgagcagcaacatcaccagcgagcaagtgcggaccatcatcgtgaaccacgtgaacgatacctggggcctgaaagtgcggcagagcctgtggtttcacctgagctgtctgaccttcggccagcacaccgtgcaagagtttctggtgtccttcggcgtgtggatcagaacccctgctccatacagacctccaaacgctcccatcctgagcaccctgcctgagcacacagtgatctgttga

SEQ ID NO: 12133 - RNA, 4098 nt, synthetic construct
  misc_feature 1..4098: note = SARS-CoV-2/Wuhan/WIV05/2019__EPI_ISL_402128 spike protein CDS gc mod (1-1211)(K986P_V987P_ H1048Q_H1064N_ H1083N_H1101N) WhcAg construct
  source 1..4098: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccagctgatgagcttccctcagtctgcccctcacggcgtggtgtttctgaacgtgacatatgtgcccgctcaagagaagaatttcaccaccgctccagccatctgcaacgacggcaaagcccactttcctagagaaggcgtgttcgtgtccaacggcaccaactggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggaggcggaggatctgacatcgacccctacaaagagttcggcagcagctaccagctgctgaacttcctgcctctggacttcttccccgacctgaacgccctggtggatacagccacagctctgtacgaggaagaactgaccggcagagagcactgcagccctcaccacacagccattagacaggccctcgtgtgctgggacgagctgacaaaactgatcgcctggatgagcagcaacatcaccagcgagcaagtgcggaccatcatcgtgaaccacgtgaacgatacctggggcctgaaagtgcggcagagcctgtggtttcacctgagctgtctgaccttcggccagcacaccgtgcaagagtttctggtgtccttcggcgtgtggatcagaacccctgctccatacagacctccaaacgctcccatcctgagcaccctgcctgagcacacagtgatctgttga

SEQ ID NO: 12134 - RNA, 4098 nt, synthetic construct
  misc_feature 1..4098: note = SARS-CoV-2/Wuhan/WIV05/2019__EPI_ISL_402128 spike protein CDS gc mod (1-1211)(I712C_T1077C) WhcAg construct
  source 1..4098: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactcttgcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcacctgtgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggaggcggaggatctgacatcgacccctacaaagagttcggcagcagctaccagctgctgaacttcctgcctctggacttcttccccgacctgaacgccctggtggatacagccacagctctgtacgaggaagaactgaccggcagagagcactgcagccctcaccacacagccattagacaggccctcgtgtgctgggacgagctgacaaaactgatcgcctggatgagcagcaacatcaccagcgagcaagtgcggaccatcatcgtgaaccacgtgaacgatacctggggcctgaaagtgcggcagagcctgtggtttcacctgagctgtctgaccttcggccagcacaccgtgcaagagtttctggtgtccttcggcgtgtggatcagaacccctgctccatacagacctccaaacgctcccatcctgagcaccctgcctgagcacacagtgatctgttga

SEQ ID NO: 12135 - RNA, 4098 nt, synthetic construct
  misc_feature 1..4098: note = SARS-CoV-2/Wuhan/WIV05/2019__EPI_ISL_402128 spike protein CDS gc mod (1-1211)(I714C_Y1110C) WhcAg construct
  source 1..4098: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgcttgccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctgtgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggaggcggaggatctgacatcgacccctacaaagagttcggcagcagctaccagctgctgaacttcctgcctctggacttcttccccgacctgaacgccctggtggatacagccacagctctgtacgaggaagaactgaccggcagagagcactgcagccctcaccacacagccattagacaggccctcgtgtgctgggacgagctgacaaaactgatcgcctggatgagcagcaacatcaccagcgagcaagtgcggaccatcatcgtgaaccacgtgaacgatacctggggcctgaaagtgcggcagagcctgtggtttcacctgagctgtctgaccttcggccagcacaccgtgcaagagtttctggtgtccttcggcgtgtggatcagaacccctgctccatacagacctccaaacgctcccatcctgagcaccctgcctgagcacacagtgatctgttga

SEQ ID NO: 12136 - RNA, 4098 nt, synthetic construct
  misc_feature 1..4098: note = SARS-CoV-2/Wuhan/WIV05/2019__EPI_ISL_402128 spike protein CDS gc mod (1-1211)(P715C_P1069C) WhcAg construct
  source 1..4098: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatctgcaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgtgtgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggaggcggaggatctgacatcgacccctacaaagagttcggcagcagctaccagctgctgaacttcctgcctctggacttcttccccgacctgaacgccctggtggatacagccacagctctgtacgaggaagaactgaccggcagagagcactgcagccctcaccacacagccattagacaggccctcgtgtgctgggacgagctgacaaaactgatcgcctggatgagcagcaacatcaccagcgagcaagtgcggaccatcatcgtgaaccacgtgaacgatacctggggcctgaaagtgcggcagagcctgtggtttcacctgagctgtctgaccttcggccagcacaccgtgcaagagtttctggtgtccttcggcgtgtggatcagaacccctgctccatacagacctccaaacgctcccatcctgagcaccctgcctgagcacacagtgatctgttga

SEQ ID NO: 12137 - RNA, 4098 nt, synthetic construct
  misc_feature 1..4098: note = SARS-CoV-2/Wuhan/WIV05/2019__EPI_ISL_402128 spike protein CDS gc mod (1-1211)(G889C_L1034C) WhcAg construct
  source 1..4098: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacattttgcgctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgtgtggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggaggcggaggatctgacatcgacccctacaaagagttcggcagcagctaccagctgctgaacttcctgcctctggacttcttccccgacctgaacgccctggtggatacagccacagctctgtacgaggaagaactgaccggcagagagcactgcagccctcaccacacagccattagacaggccctcgtgtgctgggacgagctgacaaaactgatcgcctggatgagcagcaacatcaccagcgagcaagtgcggaccatcatcgtgaaccacgtgaacgatacctggggcctgaaagtgcggcagagcctgtggtttcacctgagctgtctgaccttcggccagcacaccgtgcaagagtttctggtgtccttcggcgtgtggatcagaacccctgctccatacagacctccaaacgctcccatcctgagcaccctgcctgagcacacagtgatctgttga

SEQ ID NO: 12138 - RNA, 4098 nt, synthetic construct
  misc_feature 1..4098: note = SARS-CoV-2/Wuhan/WIV05/2019__EPI_ISL_402128 spike protein CDS gc mod (1-1211)(I909C_Y1047C) WhcAg construct
  source 1..4098: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggctgcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctgtcacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggaggcggaggatctgacatcgacccctacaaagagttcggcagcagctaccagctgctgaacttcctgcctctggacttcttccccgacctgaacgccctggtggatacagccacagctctgtacgaggaagaactgaccggcagagagcactgcagccctcaccacacagccattagacaggccctcgtgtgctgggacgagctgacaaaactgatcgcctggatgagcagcaacatcaccagcgagcaagtgcggaccatcatcgtgaaccacgtgaacgatacctggggcctgaaagtgcggcagagcctgtggtttcacctgagctgtctgaccttcggccagcacaccgtgcaagagtttctggtgtccttcggcgtgtggatcagaacccctgctccatacagacctccaaacgctcccatcctgagcaccctgcctgagcacacagtgatctgttga

SEQ ID NO: 12139 - RNA, 4098 nt, synthetic construct
  misc_feature 1..4098: note = SARS-CoV-2/Wuhan/WIV05/2019__EPI_ISL_402128 spike protein CDS gc mod (1-1211)(Q965C_S1003C) WhcAg construct
  source 1..4098: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagtgcctgtcctccaacttcggcgccatcagctctgtgctgaacgatatcctgagcagactggacaaggtcgaggccgaggtgcagatcgacagactgatcacaggcagactgcagtgtctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggaggcggaggatctgacatcgacccctacaaagagttcggcagcagctaccagctgctgaacttcctgcctctggacttcttccccgacctgaacgccctggtggatacagccacagctctgtacgaggaagaactgaccggcagagagcactgcagccctcaccacacagccattagacaggccctcgtgtgctgggacgagctgacaaaactgatcgcctggatgagcagcaacatcaccagcgagcaagtgcggaccatcatcgtgaaccacgtgaacgatacctggggcctgaaagtgcggcagagcctgtggtttcacctgagctgtctgaccttcggccagcacaccgtgcaagagtttctggtgtccttcggcgtgtggatcagaacccctgctccatacagacctccaaacgctcccatcctgagcaccctgcctgagcacacagtgatctgttga

SEQ ID NO: 12140 - RNA, 4098 nt, synthetic construct
  misc_feature 1..4098: note = SARS-CoV-2/Wuhan/WIV05/2019__EPI_ISL_402128 spike protein CDS gc mod (1-1211)(F970C_G999C) WhcAg construct
  source 1..4098: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaactgcggcgccatcagctctgtgctgaacgatatcctgagcagactggacaaggtcgaggccgaggtgcagatcgacagactgatcacatgtagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggaggcggaggatctgacatcgacccctacaaagagttcggcagcagctaccagctgctgaacttcctgcctctggacttcttccccgacctgaacgccctggtggatacagccacagctctgtacgaggaagaactgaccggcagagagcactgcagccctcaccacacagccattagacaggccctcgtgtgctgggacgagctgacaaaactgatcgcctggatgagcagcaacatcaccagcgagcaagtgcggaccatcatcgtgaaccacgtgaacgatacctggggcctgaaagtgcggcagagcctgtggtttcacctgagctgtctgaccttcggccagcacaccgtgcaagagtttctggtgtccttcggcgtgtggatcagaacccctgctccatacagacctccaaacgctcccatcctgagcaccctgcctgagcacacagtgatctgttga

SEQ ID NO: 12141 - RNA, 4098 nt, synthetic construct
  misc_feature 1..4098: note = SARS-CoV-2/Wuhan/WIV05/2019__EPI_ISL_402128 spike protein CDS gc mod (1-1211)(A972C_R995C) WhcAg construct
  source 1..4098: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggctgcatcagctctgtgctgaacgatatcctgagcagactggacaaggtcgaggccgaggtgcagatcgactgtctgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggaggcggaggatctgacatcgacccctacaaagagttcggcagcagctaccagctgctgaacttcctgcctctggacttcttccccgacctgaacgccctggtggatacagccacagctctgtacgaggaagaactgaccggcagagagcactgcagccctcaccacacagccattagacaggccctcgtgtgctgggacgagctgacaaaactgatcgcctggatgagcagcaacatcaccagcgagcaagtgcggaccatcatcgtgaaccacgtgaacgatacctggggcctgaaagtgcggcagagcctgtggtttcacctgagctgtctgaccttcggccagcacaccgtgcaagagtttctggtgtccttcggcgtgtggatcagaacccctgctccatacagacctccaaacgctcccatcctgagcaccctgcctgagcacacagtgatctgttga

SEQ ID NO: 12142 - RNA, 4098 nt, synthetic construct
  misc_feature 1..4098: note = SARS-CoV-2/Wuhan/WIV05/2019__EPI_ISL_402128 spike protein CDS gc mod (1-1211)(A890C_V1040C) WhcAg construct
  source 1..4098: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggatgcggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagatgtgacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggaggcggaggatctgacatcgacccctacaaagagttcggcagcagctaccagctgctgaacttcctgcctctggacttcttccccgacctgaacgccctggtggatacagccacagctctgtacgaggaagaactgaccggcagagagcactgcagccctcaccacacagccattagacaggccctcgtgtgctgggacgagctgacaaaactgatcgcctggatgagcagcaacatcaccagcgagcaagtgcggaccatcatcgtgaaccacgtgaacgatacctggggcctgaaagtgcggcagagcctgtggtttcacctgagctgtctgaccttcggccagcacaccgtgcaagagtttctggtgtccttcggcgtgtggatcagaacccctgctccatacagacctccaaacgctcccatcctgagcaccctgcctgagcacacagtgatctgttga

SEQ ID NO: 12143 - RNA, 4098 nt, synthetic construct
  misc_feature 1..4098: note = SARS-CoV-2/Wuhan/WIV05/2019__EPI_ISL_402128 spike protein CDS gc mod (1-1211)(T874C_S1055C) WhcAg construct
  source 1..4098: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtactgctctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtgcgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggaggcggaggatctgacatcgacccctacaaagagttcggcagcagctaccagctgctgaacttcctgcctctggacttcttccccgacctgaacgccctggtggatacagccacagctctgtacgaggaagaactgaccggcagagagcactgcagccctcaccacacagccattagacaggccctcgtgtgctgggacgagctgacaaaactgatcgcctggatgagcagcaacatcaccagcgagcaagtgcggaccatcatcgtgaaccacgtgaacgatacctggggcctgaaagtgcggcagagcctgtggtttcacctgagctgtctgaccttcggccagcacaccgtgcaagagtttctggtgtccttcggcgtgtggatcagaacccctgctccatacagacctccaaacgctcccatcctgagcaccctgcctgagcacacagtgatctgttga

SEQ ID NO: 12144 - RNA, 3924 nt, synthetic construct
  misc_feature 1..3924: note = SARS-CoV-2/Wuhan/WIV05/2019__EPI_ISL_402128 spike protein CDS gc mod (1-1147) LumSynth construct
  source 1..3924: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggcggaggatctggcggaggacagatctacgagggcaagctgacagccgagggcctgagatttggaatcgtggccagccggttcaatcacgccctggtggatagactggtggaaggcgccatcgatgccattgtcagacacggcggcagagaagaggacatcaccctcgttagagtgcccggctcttgggagattcctgtggctgctggcgagctggcccggaaagaagatatcgacgccgttatcgccatcggcgtgctgatcagaggcgccacacctcacttcgactatatcgccagcgaggtgtccaaaggcctggccgatctgagcctggaactgagaaagcccatcaccttcggcgtgatcaccgctgacacactggaacaggccattgagagagccggcaccaagcacggcaacaaaggatgggaagccgctctgtccgccatcgagatggccaacctgttcaagagcctgcggtga

SEQ ID NO: 12145 - RNA, 3924 nt, synthetic construct
  misc_feature 1..3924: note = SARS-CoV-2/Wuhan/WIV05/2019__EPI_ISL_402128 spike protein CDS gc mod (1-1147)(K986P_V987P) LumSynth construct
  source 1..3924: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggcggaggatctggcggaggacagatctacgagggcaagctgacagccgagggcctgagatttggaatcgtggccagccggttcaatcacgccctggtggatagactggtggaaggcgccatcgatgccattgtcagacacggcggcagagaagaggacatcaccctcgttagagtgcccggctcttgggagattcctgtggctgctggcgagctggcccggaaagaagatatcgacgccgttatcgccatcggcgtgctgatcagaggcgccacacctcacttcgactatatcgccagcgaggtgtccaaaggcctggccgatctgagcctggaactgagaaagcccatcaccttcggcgtgatcaccgctgacacactggaacaggccattgagagagccggcaccaagcacggcaacaaaggatgggaagccgctctgtccgccatcgagatggccaacctgttcaagagcctgcggtga

SEQ ID NO: 12146 - RNA, 3924 nt, synthetic construct
  misc_feature 1..3924: note = SARS-CoV-2/Wuhan/WIV05/2019__EPI_ISL_402128 spike protein CDS gc mod (1-1147)(K986P_V987P_T887WN_A1020W) LumSynth construct
  source 1..3924: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggtggtttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagatggtctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggcggaggatctggcggaggacagatctacgagggcaagctgacagccgagggcctgagatttggaatcgtggccagccggttcaatcacgccctggtggatagactggtggaaggcgccatcgatgccattgtcagacacggcggcagagaagaggacatcaccctcgttagagtgcccggctcttgggagattcctgtggctgctggcgagctggcccggaaagaagatatcgacgccgttatcgccatcggcgtgctgatcagaggcgccacacctcacttcgactatatcgccagcgaggtgtccaaaggcctggccgatctgagcctggaactgagaaagcccatcaccttcggcgtgatcaccgctgacacactggaacaggccattgagagagccggcaccaagcacggcaacaaaggatgggaagccgctctgtccgccatcgagatggccaacctgttcaagagcctgcggtga

SEQ ID NO: 12147 - RNA, 3924 nt, synthetic construct
  misc_feature 1..3924: note = SARS-CoV-2/Wuhan/WIV05/2019__EPI_ISL_402128 spike protein CDS gc mod (1-1147)(K986P_V987P_P1069F) LumSynth construct
  source 1..3924: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgttcgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggcggaggatctggcggaggacagatctacgagggcaagctgacagccgagggcctgagatttggaatcgtggccagccggttcaatcacgccctggtggatagactggtggaaggcgccatcgatgccattgtcagacacggcggcagagaagaggacatcaccctcgttagagtgcccggctcttgggagattcctgtggctgctggcgagctggcccggaaagaagatatcgacgccgttatcgccatcggcgtgctgatcagaggcgccacacctcacttcgactatatcgccagcgaggtgtccaaaggcctggccgatctgagcctggaactgagaaagcccatcaccttcggcgtgatcaccgctgacacactggaacaggccattgagagagccggcaccaagcacggcaacaaaggatgggaagccgctctgtccgccatcgagatggccaacctgttcaagagcctgcggtga

SEQ ID NO: 12148 - RNA, 3924 nt, synthetic construct
  misc_feature 1..3924: note = SARS-CoV-2/Wuhan/WIV05/2019__EPI_ISL_402128 spike protein CDS gc mod (1-1147)(K986P_V987P_ H1048Q_H1064N_ H1083N_H1101N) LumSynth construct
  source 1..3924: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccagctgatgagcttccctcagtctgcccctcacggcgtggtgtttctgaacgtgacatatgtgcccgctcaagagaagaatttcaccaccgctccagccatctgcaacgacggcaaagcccactttcctagagaaggcgtgttcgtgtccaacggcaccaactggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggcggaggatctggcggaggacagatctacgagggcaagctgacagccgagggcctgagatttggaatcgtggccagccggttcaatcacgccctggtggatagactggtggaaggcgccatcgatgccattgtcagacacggcggcagagaagaggacatcaccctcgttagagtgcccggctcttgggagattcctgtggctgctggcgagctggcccggaaagaagatatcgacgccgttatcgccatcggcgtgctgatcagaggcgccacacctcacttcgactatatcgccagcgaggtgtccaaaggcctggccgatctgagcctggaactgagaaagcccatcaccttcggcgtgatcaccgctgacacactggaacaggccattgagagagccggcaccaagcacggcaacaaaggatgggaagccgctctgtccgccatcgagatggccaacctgttcaagagcctgcggtga

SEQ ID NO: 12149 - RNA, 3924 nt, synthetic construct
  misc_feature 1..3924: note = SARS-CoV-2/Wuhan/WIV05/2019__EPI_ISL_402128 spike protein CDS gc mod (1-1147)(I712C_T1077C) LumSynth construct
  source 1..3924: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactcttgcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcacctgtgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggcggaggatctggcggaggacagatctacgagggcaagctgacagccgagggcctgagatttggaatcgtggccagccggttcaatcacgccctggtggatagactggtggaaggcgccatcgatgccattgtcagacacggcggcagagaagaggacatcaccctcgttagagtgcccggctcttgggagattcctgtggctgctggcgagctggcccggaaagaagatatcgacgccgttatcgccatcggcgtgctgatcagaggcgccacacctcacttcgactatatcgccagcgaggtgtccaaaggcctggccgatctgagcctggaactgagaaagcccatcaccttcggcgtgatcaccgctgacacactggaacaggccattgagagagccggcaccaagcacggcaacaaaggatgggaagccgctctgtccgccatcgagatggccaacctgttcaagagcctgcggtga

SEQ ID NO: 12150 - RNA, 3924 nt, synthetic construct
  misc_feature 1..3924: note = SARS-CoV-2/Wuhan/WIV05/2019__EPI_ISL_402128 spike protein CDS gc mod (1-1147)(I714C_Y1110C) LumSynth construct
  source 1..3924: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgcttgccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctgtgagccccagatcatcaccaccgacaacaccttcgtgtctggcaactgcgacgttgtgatcggcattgtgaacaataccgtgtacgaccctctgcagcccgagctggacagcggcggaggatctggcggaggacagatctacgagggcaagctgacagccgagggcctgagatttggaatcgtggccagccggttcaatcacgccctggtggatagactggtggaaggcgccatcgatgccattgtcagacacggcggcagagaagaggacatcaccctcgttagagtgcccggctcttgggagattcctgtggctgctggcgagctggcccggaaagaagatatcgacgccgttatcgccatcggcgtgctgatcagaggcgccacacctcacttcgactatatcgccagcgaggtgtccaaaggcctggccgatctgagcctggaactgagaaagcccatcaccttcggcgtgatcaccgctgacacactggaacaggccattgagagagccggcaccaagcacggcaacaaaggatgggaagccgctctgtccgccatcgagatggccaacctgttcaagagcctgcggtga

SEQ ID NO: 12151 - RNA, 3924 nt, synthetic construct
  misc_feature 1..3924: note = SARS-CoV-2/Wuhan/WIV05/2019__EPI_ISL_402128 spike protein CDS gc mod (1-1147)(P715C_P1069C) LumSynth construct
  source 1..3924: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatctgcaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgtgtgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggcggaggatctggcggaggacagatctacgagggcaagctgacagccgagggcctgagatttggaatcgtggccagccggttcaatcacgccctggtggatagactggtggaaggcgccatcgatgccattgtcagacacggcggcagagaagaggacatcaccctcgttagagtgcccggctcttgggagattcctgtggctgctggcgagctggcccggaaagaagatatcgacgccgttatcgccatcggcgtgctgatcagaggcgccacacctcacttcgactatatcgccagcgaggtgtccaaaggcctggccgatctgagcctggaactgagaaagcccatcaccttcggcgtgatcaccgctgacacactggaacaggccattgagagagccggcaccaagcacggcaacaaaggatgggaagccgctctgtccgccatcgagatggccaacctgttcaagagcctgcggtga

SEQ ID NO: 12152 - RNA, 3924 nt, synthetic construct
  misc_feature 1..3924: note = SARS-CoV-2/Wuhan/WIV05/2019__EPI_ISL_402128 spike protein CDS gc mod (1-1147)(G889C_L1034C) LumSynth construct
  source 1..3924: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacattttgcgctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgtgtggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggcggaggatctggcggaggacagatctacgagggcaagctgacagccgagggcctgagatttggaatcgtggccagccggttcaatcacgccctggtggatagactggtggaaggcgccatcgatgccattgtcagacacggcggcagagaagaggacatcaccctcgttagagtgcccggctcttgggagattcctgtggctgctggcgagctggcccggaaagaagatatcgacgccgttatcgccatcggcgtgctgatcagaggcgccacacctcacttcgactatatcgccagcgaggtgtccaaaggcctggccgatctgagcctggaactgagaaagcccatcaccttcggcgtgatcaccgctgacacactggaacaggccattgagagagccggcaccaagcacggcaacaaaggatgggaagccgctctgtccgccatcgagatggccaacctgttcaagagcctgcggtga

SEQ ID NO: 12153 - RNA, 3924 nt, synthetic construct
  misc_feature 1..3924: note = SARS-CoV-2/Wuhan/WIV05/2019__EPI_ISL_402128 spike protein CDS gc mod (1-1147)(I909C_Y1047C) LumSynth construct
  source 1..3924: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggctgcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctgtcacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggcggaggatctggcggaggacagatctacgagggcaagctgacagccgagggcctgagatttggaatcgtggccagccggttcaatcacgccctggtggatagactggtggaaggcgccatcgatgccattgtcagacacggcggcagagaagaggacatcaccctcgttagagtgcccggctcttgggagattcctgtggctgctggcgagctggcccggaaagaagatatcgacgccgttatcgccatcggcgtgctgatcagaggcgccacacctcacttcgactatatcgccagcgaggtgtccaaaggcctggccgatctgagcctggaactgagaaagcccatcaccttcggcgtgatcaccgctgacacactggaacaggccattgagagagccggcaccaagcacggcaacaaaggatgggaagccgctctgtccgccatcgagatggccaacctgttcaagagcctgcggtga

SEQ ID NO: 12154 - RNA, 3924 nt, synthetic construct
  misc_feature 1..3924: note = SARS-CoV-2/Wuhan/WIV05/2019__EPI_ISL_402128 spike protein CDS gc mod (1-1147)(Q965C_S1003C) LumSynth construct
  source 1..3924: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagtgcctgtcctccaacttcggcgccatcagctctgtgctgaacgatatcctgagcagactggacaaggtcgaggccgaggtgcagatcgacagactgatcacaggcagactgcagtgtctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggcggaggatctggcggaggacagatctacgagggcaagctgacagccgagggcctgagatttggaatcgtggccagccggttcaatcacgccctggtggatagactggtggaaggcgccatcgatgccattgtcagacacggcggcagagaagaggacatcaccctcgttagagtgcccggctcttgggagattcctgtggctgctggcgagctggcccggaaagaagatatcgacgccgttatcgccatcggcgtgctgatcagaggcgccacacctcacttcgactatatcgccagcgaggtgtccaaaggcctggccgatctgagcctggaactgagaaagcccatcaccttcggcgtgatcaccgctgacacactggaacaggccattgagagagccggcaccaagcacggcaacaaaggatgggaagccgctctgtccgccatcgagatggccaacctgttcaagagcctgcggtga

SEQ ID NO: 12155 - RNA, 3924 nt, synthetic construct
  misc_feature 1..3924: note = SARS-CoV-2/Wuhan/WIV05/2019__EPI_ISL_402128 spike protein CDS gc mod (1-1147)(F970C_G999C) LumSynth construct
  source 1..3924: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaactgcggcgccatcagctctgtgctgaacgatatcctgagcagactggacaaggtcgaggccgaggtgcagatcgacagactgatcacatgtagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggcggaggatctggcggaggacagatctacgagggcaagctgacagccgagggcctgagatttggaatcgtggccagccggttcaatcacgccctggtggatagactggtggaaggcgccatcgatgccattgtcagacacggcggcagagaagaggacatcaccctcgttagagtgcccggctcttgggagattcctgtggctgctggcgagctggcccggaaagaagatatcgacgccgttatcgccatcggcgtgctgatcagaggcgccacacctcacttcgactatatcgccagcgaggtgtccaaaggcctggccgatctgagcctggaactgagaaagcccatcaccttcggcgtgatcaccgctgacacactggaacaggccattgagagagccggcaccaagcacggcaacaaaggatgggaagccgctctgtccgccatcgagatggccaacctgttcaagagcctgcggtga

SEQ ID NO: 12156 - RNA, 3924 nt, synthetic construct
  misc_feature 1..3924: note = SARS-CoV-2/Wuhan/WIV05/2019__EPI_ISL_402128 spike protein CDS gc mod (1-1147)(A972C_R995C) LumSynth construct
  source 1..3924: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggctgcatcagctctgtgctgaacgatatcctgagcagactggacaaggtcgaggccgaggtgcagatcgactgtctgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggcggaggatctggcggaggacagatctacgagggcaagctgacagccgagggcctgagatttggaatcgtggccagccggttcaatcacgccctggtggatagactggtggaaggcgccatcgatgccattgtcagacacggcggcagagaagaggacatcaccctcgttagagtgcccggctcttgggagattcctgtggctgctggcgagctggcccggaaagaagatatcgacgccgttatcgccatcggcgtgctgatcagaggcgccacacctcacttcgactatatcgccagcgaggtgtccaaaggcctggccgatctgagcctggaactgagaaagcccatcaccttcggcgtgatcaccgctgacacactggaacaggccattgagagagccggcaccaagcacggcaacaaaggatgggaagccgctctgtccgccatcgagatggccaacctgttcaagagcctgcggtga

SEQ ID NO: 12157 - RNA, 3924 nt, synthetic construct
  misc_feature 1..3924: note = SARS-CoV-2/Wuhan/WIV05/2019__EPI_ISL_402128 spike protein CDS gc mod (1-1147)(A890C_V1040C) LumSynth construct
  source 1..3924: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggatgcggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagatgtgacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggcggaggatctggcggaggacagatctacgagggcaagctgacagccgagggcctgagatttggaatcgtggccagccggttcaatcacgccctggtggatagactggtggaaggcgccatcgatgccattgtcagacacggcggcagagaagaggacatcaccctcgttagagtgcccggctcttgggagattcctgtggctgctggcgagctggcccggaaagaagatatcgacgccgttatcgccatcggcgtgctgatcagaggcgccacacctcacttcgactatatcgccagcgaggtgtccaaaggcctggccgatctgagcctggaactgagaaagcccatcaccttcggcgtgatcaccgctgacacactggaacaggccattgagagagccggcaccaagcacggcaacaaaggatgggaagccgctctgtccgccatcgagatggccaacctgttcaagagcctgcggtga

SEQ ID NO: 12158 - RNA, 3924 nt, synthetic construct
  misc_feature 1..3924: note = SARS-CoV-2/Wuhan/WIV05/2019__EPI_ISL_402128 spike protein CDS gc mod (1-1147)(T874C_S1055C) LumSynth construct
  source 1..3924: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtactgctctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtgcgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggcggaggatctggcggaggacagatctacgagggcaagctgacagccgagggcctgagatttggaatcgtggccagccggttcaatcacgccctggtggatagactggtggaaggcgccatcgatgccattgtcagacacggcggcagagaagaggacatcaccctcgttagagtgcccggctcttgggagattcctgtggctgctggcgagctggcccggaaagaagatatcgacgccgttatcgccatcggcgtgctgatcagaggcgccacacctcacttcgactatatcgccagcgaggtgtccaaaggcctggccgatctgagcctggaactgagaaagcccatcaccttcggcgtgatcaccgctgacacactggaacaggccattgagagagccggcaccaagcacggcaacaaaggatgggaagccgctctgtccgccatcgagatggccaacctgttcaagagcctgcggtga

SEQ ID NO: 12159 - RNA, 3948 nt, synthetic construct
  misc_feature 1..3948: note = SARS-CoV-2/Wuhan/WIV05/2019__EPI_ISL_402128 spike protein CDS gc mod (1-1147) Ferritin construct
  source 1..3948: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggaggcggaggatctgacatcatcaagctgctgaacgagcaagtgaacaaagagatgcagagcagcaacctgtacatgagcatgagcagctggtgctacacccacagccttgatggcgccggactgttcctgtttgatcacgccgccgaggaatacgagcacgccaagaagctgatcatcttcctgaacgagaacaacgtgcccgtgcagctgaccagcatttctgcccctgagcacaagttcgagggcctgacacagatcttccagaaggcctacgaacacgagcagcacatcagcgagagcatcaacaacatcgtggaccacgccattaagagcaaggatcacgccaccttcaactttctgcagtggtacgtggccgaacagcacgaggaagaggtgctgttcaaggacatcctggacaagatcgagctgatcggcaacgagaaccacggcctgtatctggccgaccagtacgtgaagggaatcgccaagagcagaaagagctga

SEQ ID NO: 12160 - RNA, 3948 nt, synthetic construct
  misc_feature 1..3948: note = SARS-CoV-2/Wuhan/WIV05/2019__EPI_ISL_402128 spike protein CDS gc mod (1-1147)(K986P_V987P) Ferritin construct
  source 1..3948: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggaggcggaggatctgacatcatcaagctgctgaacgagcaagtgaacaaagagatgcagagcagcaacctgtacatgagcatgagcagctggtgctacacccacagccttgatggcgccggactgttcctgtttgatcacgccgccgaggaatacgagcacgccaagaagctgatcatcttcctgaacgagaacaacgtgcccgtgcagctgaccagcatttctgcccctgagcacaagttcgagggcctgacacagatcttccagaaggcctacgaacacgagcagcacatcagcgagagcatcaacaacatcgtggaccacgccattaagagcaaggatcacgccaccttcaactttctgcagtggtacgtggccgaacagcacgaggaagaggtgctgttcaaggacatcctggacaagatcgagctgatcggcaacgagaaccacggcctgtatctggccgaccagtacgtgaagggaatcgccaagagcagaaagagctga

SEQ ID NO: 12161 - RNA, 3948 nt, synthetic construct
  misc_feature 1..3948: note = SARS-CoV-2/Wuhan/WIV05/2019__EPI_ISL_402128 spike protein CDS gc mod (1-1147)(K986P_V987P_T887WN_A1020W) Ferritin construct
  source 1..3948: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggtggtttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagatggtctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggaggcggaggatctgacatcatcaagctgctgaacgagcaagtgaacaaagagatgcagagcagcaacctgtacatgagcatgagcagctggtgctacacccacagccttgatggcgccggactgttcctgtttgatcacgccgccgaggaatacgagcacgccaagaagctgatcatcttcctgaacgagaacaacgtgcccgtgcagctgaccagcatttctgcccctgagcacaagttcgagggcctgacacagatcttccagaaggcctacgaacacgagcagcacatcagcgagagcatcaacaacatcgtggaccacgccattaagagcaaggatcacgccaccttcaactttctgcagtggtacgtggccgaacagcacgaggaagaggtgctgttcaaggacatcctggacaagatcgagctgatcggcaacgagaaccacggcctgtatctggccgaccagtacgtgaagggaatcgccaagagcagaaagagctga

SEQ ID NO: 12162 - RNA, 3948 nt, synthetic construct
  misc_feature 1..3948: note = SARS-CoV-2/Wuhan/WIV05/2019__EPI_ISL_402128 spike protein CDS gc mod (1-1147)(K986P_V987P_P1069F) Ferritin construct
  source 1..3948: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgttcgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggaggcggaggatctgacatcatcaagctgctgaacgagcaagtgaacaaagagatgcagagcagcaacctgtacatgagcatgagcagctggtgctacacccacagccttgatggcgccggactgttcctgtttgatcacgccgccgaggaatacgagcacgccaagaagctgatcatcttcctgaacgagaacaacgtgcccgtgcagctgaccagcatttctgcccctgagcacaagttcgagggcctgacacagatcttccagaaggcctacgaacacgagcagcacatcagcgagagcatcaacaacatcgtggaccacgccattaagagcaaggatcacgccaccttcaactttctgcagtggtacgtggccgaacagcacgaggaagaggtgctgttcaaggacatcctggacaagatcgagctgatcggcaacgagaaccacggcctgtatctggccgaccagtacgtgaagggaatcgccaagagcagaaagagctga

SEQ ID NO: 12163 - RNA, 3948 nt, synthetic construct
  misc_feature 1..3948: note = SARS-CoV-2/Wuhan/WIV05/2019__EPI_ISL_402128 spike protein CDS gc mod (1-1147)(K986P_V987P_ H1048Q_H1064N_ H1083N_H1101N) Ferritin construct
  source 1..3948: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccagctgatgagcttccctcagtctgcccctcacggcgtggtgtttctgaacgtgacatatgtgcccgctcaagagaagaatttcaccaccgctccagccatctgcaacgacggcaaagcccactttcctagagaaggcgtgttcgtgtccaacggcaccaactggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggaggcggaggatctgacatcatcaagctgctgaacgagcaagtgaacaaagagatgcagagcagcaacctgtacatgagcatgagcagctggtgctacacccacagccttgatggcgccggactgttcctgtttgatcacgccgccgaggaatacgagcacgccaagaagctgatcatcttcctgaacgagaacaacgtgcccgtgcagctgaccagcatttctgcccctgagcacaagttcgagggcctgacacagatcttccagaaggcctacgaacacgagcagcacatcagcgagagcatcaacaacatcgtggaccacgccattaagagcaaggatcacgccaccttcaactttctgcagtggtacgtggccgaacagcacgaggaagaggtgctgttcaaggacatcctggacaagatcgagctgatcggcaacgagaaccacggcctgtatctggccgaccagtacgtgaagggaatcgccaagagcagaaagagctga

SEQ ID NO: 12164 - RNA, 3948 nt, synthetic construct
  misc_feature 1..3948: note = SARS-CoV-2/Wuhan/WIV05/2019__EPI_ISL_402128 spike protein CDS gc mod (1-1147)(I712C_T1077C) Ferritin construct
  source 1..3948: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactcttgcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcacctgtgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggaggcggaggatctgacatcatcaagctgctgaacgagcaagtgaacaaagagatgcagagcagcaacctgtacatgagcatgagcagctggtgctacacccacagccttgatggcgccggactgttcctgtttgatcacgccgccgaggaatacgagcacgccaagaagctgatcatcttcctgaacgagaacaacgtgcccgtgcagctgaccagcatttctgcccctgagcacaagttcgagggcctgacacagatcttccagaaggcctacgaacacgagcagcacatcagcgagagcatcaacaacatcgtggaccacgccattaagagcaaggatcacgccaccttcaactttctgcagtggtacgtggccgaacagcacgaggaagaggtgctgttcaaggacatcctggacaagatcgagctgatcggcaacgagaaccacggcctgtatctggccgaccagtacgtgaagggaatcgccaagagcagaaagagctga

SEQ ID NO: 12165 - RNA, 3948 nt, synthetic construct
  misc_feature 1..3948: note = SARS-CoV-2/Wuhan/WIV05/2019__EPI_ISL_402128 spike protein CDS gc mod (1-1147)(I714C_Y1110C) Ferritin construct
  source 1..3948: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgcttgccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctgtgagccccagatcatcaccaccgacaacaccttcgtgtctggcaactgcgacgttgtgatcggcattgtgaacaataccgtgtacgaccctctgcagcccgagctggacagcggaggcggaggatctgacatcatcaagctgctgaacgagcaagtgaacaaagagatgcagagcagcaacctgtacatgagcatgagcagctggtgctacacccacagccttgatggcgccggactgttcctgtttgatcacgccgccgaggaatacgagcacgccaagaagctgatcatcttcctgaacgagaacaacgtgcccgtgcagctgaccagcatttctgcccctgagcacaagttcgagggcctgacacagatcttccagaaggcctacgaacacgagcagcacatcagcgagagcatcaacaacatcgtggaccacgccattaagagcaaggatcacgccaccttcaactttctgcagtggtacgtggccgaacagcacgaggaagaggtgctgttcaaggacatcctggacaagatcgagctgatcggcaacgagaaccacggcctgtatctggccgaccagtacgtgaagggaatcgccaagagcagaaagagctga

SEQ ID NO: 12166 - RNA, 3948 nt, synthetic construct
  misc_feature 1..3948: note = SARS-CoV-2/Wuhan/WIV05/2019__EPI_ISL_402128 spike protein CDS gc mod (1-1147)(P715C_P1069C) Ferritin construct
  source 1..3948: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatctgcaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgtgtgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggaggcggaggatctgacatcatcaagctgctgaacgagcaagtgaacaaagagatgcagagcagcaacctgtacatgagcatgagcagctggtgctacacccacagccttgatggcgccggactgttcctgtttgatcacgccgccgaggaatacgagcacgccaagaagctgatcatcttcctgaacgagaacaacgtgcccgtgcagctgaccagcatttctgcccctgagcacaagttcgagggcctgacacagatcttccagaaggcctacgaacacgagcagcacatcagcgagagcatcaacaacatcgtggaccacgccattaagagcaaggatcacgccaccttcaactttctgcagtggtacgtggccgaacagcacgaggaagaggtgctgttcaaggacatcctggacaagatcgagctgatcggcaacgagaaccacggcctgtatctggccgaccagtacgtgaagggaatcgccaagagcagaaagagctga

SEQ ID NO: 12167 - RNA, 3948 nt, synthetic construct
  misc_feature 1..3948: note = SARS-CoV-2/Wuhan/WIV05/2019__EPI_ISL_402128 spike protein CDS gc mod (1-1147)(G889C_L1034C) Ferritin construct
  source 1..3948: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacattttgcgctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgtgtggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggaggcggaggatctgacatcatcaagctgctgaacgagcaagtgaacaaagagatgcagagcagcaacctgtacatgagcatgagcagctggtgctacacccacagccttgatggcgccggactgttcctgtttgatcacgccgccgaggaatacgagcacgccaagaagctgatcatcttcctgaacgagaacaacgtgcccgtgcagctgaccagcatttctgcccctgagcacaagttcgagggcctgacacagatcttccagaaggcctacgaacacgagcagcacatcagcgagagcatcaacaacatcgtggaccacgccattaagagcaaggatcacgccaccttcaactttctgcagtggtacgtggccgaacagcacgaggaagaggtgctgttcaaggacatcctggacaagatcgagctgatcggcaacgagaaccacggcctgtatctggccgaccagtacgtgaagggaatcgccaagagcagaaagagctga

SEQ ID NO: 12168 - RNA, 3948 nt, synthetic construct
  misc_feature 1..3948: note = SARS-CoV-2/Wuhan/WIV05/2019__EPI_ISL_402128 spike protein CDS gc mod (1-1147)(I909C_Y1047C) Ferritin construct
  source 1..3948: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggctgcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctgtcacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggaggcggaggatctgacatcatcaagctgctgaacgagcaagtgaacaaagagatgcagagcagcaacctgtacatgagcatgagcagctggtgctacacccacagccttgatggcgccggactgttcctgtttgatcacgccgccgaggaatacgagcacgccaagaagctgatcatcttcctgaacgagaacaacgtgcccgtgcagctgaccagcatttctgcccctgagcacaagttcgagggcctgacacagatcttccagaaggcctacgaacacgagcagcacatcagcgagagcatcaacaacatcgtggaccacgccattaagagcaaggatcacgccaccttcaactttctgcagtggtacgtggccgaacagcacgaggaagaggtgctgttcaaggacatcctggacaagatcgagctgatcggcaacgagaaccacggcctgtatctggccgaccagtacgtgaagggaatcgccaagagcagaaagagctga

SEQ ID NO: 12169 - RNA, 3948 nt, synthetic construct
  misc_feature 1..3948: note = SARS-CoV-2/Wuhan/WIV05/2019__EPI_ISL_402128 spike protein CDS gc mod (1-1147)(Q965C_S1003C) Ferritin construct
  source 1..3948: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagtgcctgtcctccaacttcggcgccatcagctctgtgctgaacgatatcctgagcagactggacaaggtcgaggccgaggtgcagatcgacagactgatcacaggcagactgcagtgtctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggaggcggaggatctgacatcatcaagctgctgaacgagcaagtgaacaaagagatgcagagcagcaacctgtacatgagcatgagcagctggtgctacacccacagccttgatggcgccggactgttcctgtttgatcacgccgccgaggaatacgagcacgccaagaagctgatcatcttcctgaacgagaacaacgtgcccgtgcagctgaccagcatttctgcccctgagcacaagttcgagggcctgacacagatcttccagaaggcctacgaacacgagcagcacatcagcgagagcatcaacaacatcgtggaccacgccattaagagcaaggatcacgccaccttcaactttctgcagtggtacgtggccgaacagcacgaggaagaggtgctgttcaaggacatcctggacaagatcgagctgatcggcaacgagaaccacggcctgtatctggccgaccagtacgtgaagggaatcgccaagagcagaaagagctga

SEQ ID NO: 12170 - RNA, 3948 nt, synthetic construct
  misc_feature 1..3948: note = SARS-CoV-2/Wuhan/WIV05/2019__EPI_ISL_402128 spike protein CDS gc mod (1-1147)(F970C_G999C) Ferritin construct
  source 1..3948: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaactgcggcgccatcagctctgtgctgaacgatatcctgagcagactggacaaggtcgaggccgaggtgcagatcgacagactgatcacatgtagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggaggcggaggatctgacatcatcaagctgctgaacgagcaagtgaacaaagagatgcagagcagcaacctgtacatgagcatgagcagctggtgctacacccacagccttgatggcgccggactgttcctgtttgatcacgccgccgaggaatacgagcacgccaagaagctgatcatcttcctgaacgagaacaacgtgcccgtgcagctgaccagcatttctgcccctgagcacaagttcgagggcctgacacagatcttccagaaggcctacgaacacgagcagcacatcagcgagagcatcaacaacatcgtggaccacgccattaagagcaaggatcacgccaccttcaactttctgcagtggtacgtggccgaacagcacgaggaagaggtgctgttcaaggacatcctggacaagatcgagctgatcggcaacgagaaccacggcctgtatctggccgaccagtacgtgaagggaatcgccaagagcagaaagagctga

SEQ ID NO: 12171 - RNA, 3948 nt, synthetic construct
  misc_feature 1..3948: note = SARS-CoV-2/Wuhan/WIV05/2019__EPI_ISL_402128 spike protein CDS gc mod (1-1147)(A972C_R995C) Ferritin construct
  source 1..3948: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggctgcatcagctctgtgctgaacgatatcctgagcagactggacaaggtcgaggccgaggtgcagatcgactgtctgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggaggcggaggatctgacatcatcaagctgctgaacgagcaagtgaacaaagagatgcagagcagcaacctgtacatgagcatgagcagctggtgctacacccacagccttgatggcgccggactgttcctgtttgatcacgccgccgaggaatacgagcacgccaagaagctgatcatcttcctgaacgagaacaacgtgcccgtgcagctgaccagcatttctgcccctgagcacaagttcgagggcctgacacagatcttccagaaggcctacgaacacgagcagcacatcagcgagagcatcaacaacatcgtggaccacgccattaagagcaaggatcacgccaccttcaactttctgcagtggtacgtggccgaacagcacgaggaagaggtgctgttcaaggacatcctggacaagatcgagctgatcggcaacgagaaccacggcctgtatctggccgaccagtacgtgaagggaatcgccaagagcagaaagagctga

SEQ ID NO: 12172 - RNA, 3948 nt, synthetic construct
  misc_feature 1..3948: note = SARS-CoV-2/Wuhan/WIV05/2019__EPI_ISL_402128 spike protein CDS gc mod (1-1147)(A890C_V1040C) Ferritin construct
  source 1..3948: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggatgcggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagatgtgacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggaggcggaggatctgacatcatcaagctgctgaacgagcaagtgaacaaagagatgcagagcagcaacctgtacatgagcatgagcagctggtgctacacccacagccttgatggcgccggactgttcctgtttgatcacgccgccgaggaatacgagcacgccaagaagctgatcatcttcctgaacgagaacaacgtgcccgtgcagctgaccagcatttctgcccctgagcacaagttcgagggcctgacacagatcttccagaaggcctacgaacacgagcagcacatcagcgagagcatcaacaacatcgtggaccacgccattaagagcaaggatcacgccaccttcaactttctgcagtggtacgtggccgaacagcacgaggaagaggtgctgttcaaggacatcctggacaagatcgagctgatcggcaacgagaaccacggcctgtatctggccgaccagtacgtgaagggaatcgccaagagcagaaagagctga

SEQ ID NO: 12173 - RNA, 3948 nt, synthetic construct
  misc_feature 1..3948: note = SARS-CoV-2/Wuhan/WIV05/2019__EPI_ISL_402128 spike protein CDS gc mod (1-1147)(T874C_S1055C) Ferritin construct
  source 1..3948: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtactgctctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtgcgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggaggcggaggatctgacatcatcaagctgctgaacgagcaagtgaacaaagagatgcagagcagcaacctgtacatgagcatgagcagctggtgctacacccacagccttgatggcgccggactgttcctgtttgatcacgccgccgaggaatacgagcacgccaagaagctgatcatcttcctgaacgagaacaacgtgcccgtgcagctgaccagcatttctgcccctgagcacaagttcgagggcctgacacagatcttccagaaggcctacgaacacgagcagcacatcagcgagagcatcaacaacatcgtggaccacgccattaagagcaaggatcacgccaccttcaactttctgcagtggtacgtggccgaacagcacgaggaagaggtgctgttcaaggacatcctggacaagatcgagctgatcggcaacgagaaccacggcctgtatctggccgaccagtacgtgaagggaatcgccaagagcagaaagagctga

SEQ ID NO: 12174 - RNA, 3534 nt, synthetic construct
  misc_feature 1..3534: note = SARS-CoV-2/Wuhan/WIV05/2019__EPI_ISL_402128 spike protein CDS gc mod (1-1147) Foldon construct
  source 1..3534: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggaggatctggctatatccccgaggctcctagagatggccaggcctatgttcggaaggatggcgaatgggtgctgctgagcaccttcctttga

SEQ ID NO: 12175 - RNA, 3534 nt, synthetic construct
  misc_feature 1..3534: note = SARS-CoV-2/Wuhan/WIV05/2019__EPI_ISL_402128 spike protein CDS gc mod (1-1147)(K986P_V987P) Foldon construct
  source 1..3534: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggaggatctggctatatccccgaggctcctagagatggccaggcctatgttcggaaggatggcgaatgggtgctgctgagcaccttcctttga

SEQ ID NO: 12176 - RNA, 3534 nt, synthetic construct
  misc_feature 1..3534: note = SARS-CoV-2/Wuhan/WIV05/2019__EPI_ISL_402128 spike protein CDS gc mod (1-1147)(K986P_V987P_T887WN_A1020W) Foldon construct
  source 1..3534: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggtggtttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagatggtctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggaggatctggctatatccccgaggctcctagagatggccaggcctatgttcggaaggatggcgaatgggtgctgctgagcaccttcctttga

SEQ ID NO: 12177 - RNA, 3534 nt, synthetic construct
  misc_feature 1..3534: note = SARS-CoV-2/Wuhan/WIV05/2019__EPI_ISL_402128 spike protein CDS gc mod (1-1147)(K986P_V987P_P1069F) Foldon construct
  source 1..3534: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgttcgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggaggatctggctatatccccgaggctcctagagatggccaggcctatgttcggaaggatggcgaatgggtgctgctgagcaccttcctttga

SEQ ID NO: 12178 - RNA, 3534 nt, synthetic construct
  misc_feature 1..3534: note = SARS-CoV-2/Wuhan/WIV05/2019__EPI_ISL_402128 spike protein CDS gc mod (1-1147)(K986P_V987P_ H1048Q_H1064N_ H1083N_H1101N) Foldon construct
  source 1..3534: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccagctgatgagcttccctcagtctgcccctcacggcgtggtgtttctgaacgtgacatatgtgcccgctcaagagaagaatttcaccaccgctccagccatctgcaacgacggcaaagcccactttcctagagaaggcgtgttcgtgtccaacggcaccaactggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggaggatctggctatatccccgaggctcctagagatggccaggcctatgttcggaaggatggcgaatgggtgctgctgagcaccttcctttga

SEQ ID NO: 12179 - RNA, 3534 nt, synthetic construct
  misc_feature 1..3534: note = SARS-CoV-2/Wuhan/WIV05/2019__EPI_ISL_402128 spike protein CDS gc mod (1-1147)(I712C_T1077C) Foldon construct
  source 1..3534: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactcttgcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcacctgtgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggaggatctggctatatccccgaggctcctagagatggccaggcctatgttcggaaggatggcgaatgggtgctgctgagcaccttcctttga

SEQ ID NO: 12180 - RNA, 3534 nt, synthetic construct
  misc_feature 1..3534: note = SARS-CoV-2/Wuhan/WIV05/2019__EPI_ISL_402128 spike protein CDS gc mod (1-1147)(I714C_Y1110C) Foldon construct
  source 1..3534: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgcttgccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctgtgagccccagatcatcaccaccgacaacaccttcgtgtctggcaactgcgacgttgtgatcggcattgtgaacaataccgtgtacgaccctctgcagcccgagctggacagcggaggatctggctatatccccgaggctcctagagatggccaggcctatgttcggaaggatggcgaatgggtgctgctgagcaccttcctttga

SEQ ID NO: 12181 - RNA, 3534 nt, synthetic construct
  misc_feature 1..3534: note = SARS-CoV-2/Wuhan/WIV05/2019__EPI_ISL_402128 spike protein CDS gc mod (1-1147)(P715C_P1069C) Foldon construct
  source 1..3534: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatctgcaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgtgtgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggaggatctggctatatccccgaggctcctagagatggccaggcctatgttcggaaggatggcgaatgggtgctgctgagcaccttcctttga

SEQ ID NO: 12182 - RNA, 3534 nt, synthetic construct
  misc_feature 1..3534: note = SARS-CoV-2/Wuhan/WIV05/2019__EPI_ISL_402128 spike protein CDS gc mod (1-1147)(G889C_L1034C) Foldon construct
  source 1..3534: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacattttgcgctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgtgtggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggaggatctggctatatccccgaggctcctagagatggccaggcctatgttcggaaggatggcgaatgggtgctgctgagcaccttcctttga

SEQ ID NO: 12183 - RNA, 3534 nt, synthetic construct
  misc_feature 1..3534: note = SARS-CoV-2/Wuhan/WIV05/2019__EPI_ISL_402128 spike protein CDS gc mod (1-1147)(I909C_Y1047C) Foldon construct
  source 1..3534: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggctgcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctgtcacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggaggatctggctatatccccgaggctcctagagatggccaggcctatgttcggaaggatggcgaatgggtgctgctgagcaccttcctttga

SEQ ID NO: 12184 - RNA, 3534 nt, synthetic construct
  misc_feature 1..3534: note = SARS-CoV-2/Wuhan/WIV05/2019__EPI_ISL_402128 spike protein CDS gc mod (1-1147)(Q965C_S1003C) Foldon construct
  source 1..3534: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagtgcctgtcctccaacttcggcgccatcagctctgtgctgaacgatatcctgagcagactggacaaggtcgaggccgaggtgcagatcgacagactgatcacaggcagactgcagtgtctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggaggatctggctatatccccgaggctcctagagatggccaggcctatgttcggaaggatggcgaatgggtgctgctgagcaccttcctttga

SEQ ID NO: 12185 - RNA, 3534 nt, synthetic construct
  misc_feature 1..3534: note = SARS-CoV-2/Wuhan/WIV05/2019__EPI_ISL_402128 spike protein CDS gc mod (1-1147)(F970C_G999C) Foldon construct
  source 1..3534: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaactgcggcgccatcagctctgtgctgaacgatatcctgagcagactggacaaggtcgaggccgaggtgcagatcgacagactgatcacatgtagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggaggatctggctatatccccgaggctcctagagatggccaggcctatgttcggaaggatggcgaatgggtgctgctgagcaccttcctttga

SEQ ID NO: 12186 - RNA, 3534 nt, synthetic construct
  misc_feature 1..3534: note = SARS-CoV-2/Wuhan/WIV05/2019__EPI_ISL_402128 spike protein CDS gc mod (1-1147)(A972C_R995C) Foldon construct
  source 1..3534: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggctgcatcagctctgtgctgaacgatatcctgagcagactggacaaggtcgaggccgaggtgcagatcgactgtctgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggaggatctggctatatccccgaggctcctagagatggccaggcctatgttcggaaggatggcgaatgggtgctgctgagcaccttcctttga

SEQ ID NO: 12187 - RNA, 3534 nt, synthetic construct
  misc_feature 1..3534: note = SARS-CoV-2/Wuhan/WIV05/2019__EPI_ISL_402128 spike protein CDS gc mod (1-1147)(A890C_V1040C) Foldon construct
  source 1..3534: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggatgcggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagatgtgacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggaggatctggctatatccccgaggctcctagagatggccaggcctatgttcggaaggatggcgaatgggtgctgctgagcaccttcctttga

SEQ ID NO: 12188 - RNA, 3534 nt, synthetic construct
  misc_feature 1..3534: note = SARS-CoV-2/Wuhan/WIV05/2019__EPI_ISL_402128 spike protein CDS gc mod (1-1147)(T874C_S1055C) Foldon construct
  source 1..3534: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtactgctctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtgcgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggaggatctggctatatccccgaggctcctagagatggccaggcctatgttcggaaggatggcgaatgggtgctgctgagcaccttcctttga

SEQ ID NO: 12189 - RNA, 3906 nt, synthetic construct
  misc_feature 1..3906: note = SARS-CoV-2/Wuhan/WIV05/2019__EPI_ISL_402128 spike protein CDS gc mod (1-1147) WhcAg construct
  source 1..3906: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggaggcggaggatctgacatcgacccctacaaagagttcggcagcagctaccagctgctgaacttcctgcctctggacttcttccccgacctgaacgccctggtggatacagccacagctctgtacgaggaagaactgaccggcagagagcactgcagccctcaccacacagccattagacaggccctcgtgtgctgggacgagctgacaaaactgatcgcctggatgagcagcaacatcaccagcgagcaagtgcggaccatcatcgtgaaccacgtgaacgatacctggggcctgaaagtgcggcagagcctgtggtttcacctgagctgtctgaccttcggccagcacaccgtgcaagagtttctggtgtccttcggcgtgtggatcagaacccctgctccatacagacctccaaacgctcccatcctgagcaccctgcctgagcacacagtgatctgttga

SEQ ID NO: 12190 - RNA, 3906 nt, synthetic construct
  misc_feature 1..3906: note = SARS-CoV-2/Wuhan/WIV05/2019__EPI_ISL_402128 spike protein CDS gc mod (1-1147)(K986P_V987P) WhcAg construct
  source 1..3906: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggaggcggaggatctgacatcgacccctacaaagagttcggcagcagctaccagctgctgaacttcctgcctctggacttcttccccgacctgaacgccctggtggatacagccacagctctgtacgaggaagaactgaccggcagagagcactgcagccctcaccacacagccattagacaggccctcgtgtgctgggacgagctgacaaaactgatcgcctggatgagcagcaacatcaccagcgagcaagtgcggaccatcatcgtgaaccacgtgaacgatacctggggcctgaaagtgcggcagagcctgtggtttcacctgagctgtctgaccttcggccagcacaccgtgcaagagtttctggtgtccttcggcgtgtggatcagaacccctgctccatacagacctccaaacgctcccatcctgagcaccctgcctgagcacacagtgatctgttga

SEQ ID NO: 12191 - RNA, 3906 nt, synthetic construct
  misc_feature 1..3906: note = SARS-CoV-2/Wuhan/WIV05/2019__EPI_ISL_402128 spike protein CDS gc mod (1-1147)(K986P_V987P_T887WN_A1020W) WhcAg construct
  source 1..3906: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggtggtttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagatggtctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggaggcggaggatctgacatcgacccctacaaagagttcggcagcagctaccagctgctgaacttcctgcctctggacttcttccccgacctgaacgccctggtggatacagccacagctctgtacgaggaagaactgaccggcagagagcactgcagccctcaccacacagccattagacaggccctcgtgtgctgggacgagctgacaaaactgatcgcctggatgagcagcaacatcaccagcgagcaagtgcggaccatcatcgtgaaccacgtgaacgatacctggggcctgaaagtgcggcagagcctgtggtttcacctgagctgtctgaccttcggccagcacaccgtgcaagagtttctggtgtccttcggcgtgtggatcagaacccctgctccatacagacctccaaacgctcccatcctgagcaccctgcctgagcacacagtgatctgttga

SEQ ID NO: 12192 - RNA, 3906 nt, synthetic construct
  misc_feature 1..3906: note = SARS-CoV-2/Wuhan/WIV05/2019__EPI_ISL_402128 spike protein CDS gc mod (1-1147)(K986P_V987P_P1069F) WhcAg construct
  source 1..3906: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgttcgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggaggcggaggatctgacatcgacccctacaaagagttcggcagcagctaccagctgctgaacttcctgcctctggacttcttccccgacctgaacgccctggtggatacagccacagctctgtacgaggaagaactgaccggcagagagcactgcagccctcaccacacagccattagacaggccctcgtgtgctgggacgagctgacaaaactgatcgcctggatgagcagcaacatcaccagcgagcaagtgcggaccatcatcgtgaaccacgtgaacgatacctggggcctgaaagtgcggcagagcctgtggtttcacctgagctgtctgaccttcggccagcacaccgtgcaagagtttctggtgtccttcggcgtgtggatcagaacccctgctccatacagacctccaaacgctcccatcctgagcaccctgcctgagcacacagtgatctgttga

SEQ ID NO: 12193 - RNA, 3906 nt, synthetic construct
  misc_feature 1..3906: note = SARS-CoV-2/Wuhan/WIV05/2019__EPI_ISL_402128 spike protein CDS gc mod (1-1147)(K986P_V987P_ H1048Q_H1064N_ H1083N_H1101N) WhcAg construct
  source 1..3906: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccagctgatgagcttccctcagtctgcccctcacggcgtggtgtttctgaacgtgacatatgtgcccgctcaagagaagaatttcaccaccgctccagccatctgcaacgacggcaaagcccactttcctagagaaggcgtgttcgtgtccaacggcaccaactggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggaggcggaggatctgacatcgacccctacaaagagttcggcagcagctaccagctgctgaacttcctgcctctggacttcttccccgacctgaacgccctggtggatacagccacagctctgtacgaggaagaactgaccggcagagagcactgcagccctcaccacacagccattagacaggccctcgtgtgctgggacgagctgacaaaactgatcgcctggatgagcagcaacatcaccagcgagcaagtgcggaccatcatcgtgaaccacgtgaacgatacctggggcctgaaagtgcggcagagcctgtggtttcacctgagctgtctgaccttcggccagcacaccgtgcaagagtttctggtgtccttcggcgtgtggatcagaacccctgctccatacagacctccaaacgctcccatcctgagcaccctgcctgagcacacagtgatctgttga

SEQ ID NO: 12194 - RNA, 3906 nt, synthetic construct
  misc_feature 1..3906: note = SARS-CoV-2/Wuhan/WIV05/2019__EPI_ISL_402128 spike protein CDS gc mod (1-1147)(I712C_T1077C) WhcAg construct
  source 1..3906: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactcttgcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcacctgtgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggaggcggaggatctgacatcgacccctacaaagagttcggcagcagctaccagctgctgaacttcctgcctctggacttcttccccgacctgaacgccctggtggatacagccacagctctgtacgaggaagaactgaccggcagagagcactgcagccctcaccacacagccattagacaggccctcgtgtgctgggacgagctgacaaaactgatcgcctggatgagcagcaacatcaccagcgagcaagtgcggaccatcatcgtgaaccacgtgaacgatacctggggcctgaaagtgcggcagagcctgtggtttcacctgagctgtctgaccttcggccagcacaccgtgcaagagtttctggtgtccttcggcgtgtggatcagaacccctgctccatacagacctccaaacgctcccatcctgagcaccctgcctgagcacacagtgatctgttga

SEQ ID NO: 12195 - RNA, 3906 nt, synthetic construct
  misc_feature 1..3906: note = SARS-CoV-2/Wuhan/WIV05/2019__EPI_ISL_402128 spike protein CDS gc mod (1-1147)(I714C_Y1110C) WhcAg construct
  source 1..3906: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgcttgccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctgtgagccccagatcatcaccaccgacaacaccttcgtgtctggcaactgcgacgttgtgatcggcattgtgaacaataccgtgtacgaccctctgcagcccgagctggacagcggaggcggaggatctgacatcgacccctacaaagagttcggcagcagctaccagctgctgaacttcctgcctctggacttcttccccgacctgaacgccctggtggatacagccacagctctgtacgaggaagaactgaccggcagagagcactgcagccctcaccacacagccattagacaggccctcgtgtgctgggacgagctgacaaaactgatcgcctggatgagcagcaacatcaccagcgagcaagtgcggaccatcatcgtgaaccacgtgaacgatacctggggcctgaaagtgcggcagagcctgtggtttcacctgagctgtctgaccttcggccagcacaccgtgcaagagtttctggtgtccttcggcgtgtggatcagaacccctgctccatacagacctccaaacgctcccatcctgagcaccctgcctgagcacacagtgatctgttga

SEQ ID NO: 12196 - RNA, 3906 nt, synthetic construct
  misc_feature 1..3906: note = SARS-CoV-2/Wuhan/WIV05/2019__EPI_ISL_402128 spike protein CDS gc mod (1-1147)(P715C_P1069C) WhcAg construct
  source 1..3906: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatctgcaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgtgtgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggaggcggaggatctgacatcgacccctacaaagagttcggcagcagctaccagctgctgaacttcctgcctctggacttcttccccgacctgaacgccctggtggatacagccacagctctgtacgaggaagaactgaccggcagagagcactgcagccctcaccacacagccattagacaggccctcgtgtgctgggacgagctgacaaaactgatcgcctggatgagcagcaacatcaccagcgagcaagtgcggaccatcatcgtgaaccacgtgaacgatacctggggcctgaaagtgcggcagagcctgtggtttcacctgagctgtctgaccttcggccagcacaccgtgcaagagtttctggtgtccttcggcgtgtggatcagaacccctgctccatacagacctccaaacgctcccatcctgagcaccctgcctgagcacacagtgatctgttga

SEQ ID NO: 12197 - RNA, 3906 nt, synthetic construct
  misc_feature 1..3906: note = SARS-CoV-2/Wuhan/WIV05/2019__EPI_ISL_402128 spike protein CDS gc mod (1-1147)(G889C_L1034C) WhcAg construct
  source 1..3906: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacattttgcgctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgtgtggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggaggcggaggatctgacatcgacccctacaaagagttcggcagcagctaccagctgctgaacttcctgcctctggacttcttccccgacctgaacgccctggtggatacagccacagctctgtacgaggaagaactgaccggcagagagcactgcagccctcaccacacagccattagacaggccctcgtgtgctgggacgagctgacaaaactgatcgcctggatgagcagcaacatcaccagcgagcaagtgcggaccatcatcgtgaaccacgtgaacgatacctggggcctgaaagtgcggcagagcctgtggtttcacctgagctgtctgaccttcggccagcacaccgtgcaagagtttctggtgtccttcggcgtgtggatcagaacccctgctccatacagacctccaaacgctcccatcctgagcaccctgcctgagcacacagtgatctgttga

SEQ ID NO: 12198 - RNA, 3906 nt, synthetic construct
  misc_feature 1..3906: note = SARS-CoV-2/Wuhan/WIV05/2019__EPI_ISL_402128 spike protein CDS gc mod (1-1147)(I909C_Y1047C) WhcAg construct
  source 1..3906: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggctgcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctgtcacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggaggcggaggatctgacatcgacccctacaaagagttcggcagcagctaccagctgctgaacttcctgcctctggacttcttccccgacctgaacgccctggtggatacagccacagctctgtacgaggaagaactgaccggcagagagcactgcagccctcaccacacagccattagacaggccctcgtgtgctgggacgagctgacaaaactgatcgcctggatgagcagcaacatcaccagcgagcaagtgcggaccatcatcgtgaaccacgtgaacgatacctggggcctgaaagtgcggcagagcctgtggtttcacctgagctgtctgaccttcggccagcacaccgtgcaagagtttctggtgtccttcggcgtgtggatcagaacccctgctccatacagacctccaaacgctcccatcctgagcaccctgcctgagcacacagtgatctgttga

SEQ ID NO: 12199 - RNA, 3906 nt, synthetic construct
  misc_feature 1..3906: note = SARS-CoV-2/Wuhan/WIV05/2019__EPI_ISL_402128 spike protein CDS gc mod (1-1147)(Q965C_S1003C) WhcAg construct
  source 1..3906: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagtgcctgtcctccaacttcggcgccatcagctctgtgctgaacgatatcctgagcagactggacaaggtcgaggccgaggtgcagatcgacagactgatcacaggcagactgcagtgtctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggaggcggaggatctgacatcgacccctacaaagagttcggcagcagctaccagctgctgaacttcctgcctctggacttcttccccgacctgaacgccctggtggatacagccacagctctgtacgaggaagaactgaccggcagagagcactgcagccctcaccacacagccattagacaggccctcgtgtgctgggacgagctgacaaaactgatcgcctggatgagcagcaacatcaccagcgagcaagtgcggaccatcatcgtgaaccacgtgaacgatacctggggcctgaaagtgcggcagagcctgtggtttcacctgagctgtctgaccttcggccagcacaccgtgcaagagtttctggtgtccttcggcgtgtggatcagaacccctgctccatacagacctccaaacgctcccatcctgagcaccctgcctgagcacacagtgatctgttga

SEQ ID NO: 12200 - RNA, 3906 nt, synthetic construct
  misc_feature 1..3906: note = SARS-CoV-2/Wuhan/WIV05/2019__EPI_ISL_402128 spike protein CDS gc mod (1-1147)(F970C_G999C) WhcAg construct
  source 1..3906: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaactgcggcgccatcagctctgtgctgaacgatatcctgagcagactggacaaggtcgaggccgaggtgcagatcgacagactgatcacatgtagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggaggcggaggatctgacatcgacccctacaaagagttcggcagcagctaccagctgctgaacttcctgcctctggacttcttccccgacctgaacgccctggtggatacagccacagctctgtacgaggaagaactgaccggcagagagcactgcagccctcaccacacagccattagacaggccctcgtgtgctgggacgagctgacaaaactgatcgcctggatgagcagcaacatcaccagcgagcaagtgcggaccatcatcgtgaaccacgtgaacgatacctggggcctgaaagtgcggcagagcctgtggtttcacctgagctgtctgaccttcggccagcacaccgtgcaagagtttctggtgtccttcggcgtgtggatcagaacccctgctccatacagacctccaaacgctcccatcctgagcaccctgcctgagcacacagtgatctgttga

SEQ ID NO: 12201 - RNA, 3906 nt, synthetic construct
  misc_feature 1..3906: note = SARS-CoV-2/Wuhan/WIV05/2019__EPI_ISL_402128 spike protein CDS gc mod (1-1147)(A972C_R995C) WhcAg construct
  source 1..3906: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggctgcatcagctctgtgctgaacgatatcctgagcagactggacaaggtcgaggccgaggtgcagatcgactgtctgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggaggcggaggatctgacatcgacccctacaaagagttcggcagcagctaccagctgctgaacttcctgcctctggacttcttccccgacctgaacgccctggtggatacagccacagctctgtacgaggaagaactgaccggcagagagcactgcagccctcaccacacagccattagacaggccctcgtgtgctgggacgagctgacaaaactgatcgcctggatgagcagcaacatcaccagcgagcaagtgcggaccatcatcgtgaaccacgtgaacgatacctggggcctgaaagtgcggcagagcctgtggtttcacctgagctgtctgaccttcggccagcacaccgtgcaagagtttctggtgtccttcggcgtgtggatcagaacccctgctccatacagacctccaaacgctcccatcctgagcaccctgcctgagcacacagtgatctgttga

SEQ ID NO: 12202 - RNA, 3906 nt, synthetic construct
  misc_feature 1..3906: note = SARS-CoV-2/Wuhan/WIV05/2019__EPI_ISL_402128 spike protein CDS gc mod (1-1147)(A890C_V1040C) WhcAg construct
  source 1..3906: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggatgcggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagatgtgacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggaggcggaggatctgacatcgacccctacaaagagttcggcagcagctaccagctgctgaacttcctgcctctggacttcttccccgacctgaacgccctggtggatacagccacagctctgtacgaggaagaactgaccggcagagagcactgcagccctcaccacacagccattagacaggccctcgtgtgctgggacgagctgacaaaactgatcgcctggatgagcagcaacatcaccagcgagcaagtgcggaccatcatcgtgaaccacgtgaacgatacctggggcctgaaagtgcggcagagcctgtggtttcacctgagctgtctgaccttcggccagcacaccgtgcaagagtttctggtgtccttcggcgtgtggatcagaacccctgctccatacagacctccaaacgctcccatcctgagcaccctgcctgagcacacagtgatctgttga

SEQ ID NO: 12203 - RNA, 3906 nt, synthetic construct
  misc_feature 1..3906: note = SARS-CoV-2/Wuhan/WIV05/2019__EPI_ISL_402128 spike protein CDS gc mod (1-1147)(T874C_S1055C) WhcAg construct
  source 1..3906: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtactgctctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtgcgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggaggcggaggatctgacatcgacccctacaaagagttcggcagcagctaccagctgctgaacttcctgcctctggacttcttccccgacctgaacgccctggtggatacagccacagctctgtacgaggaagaactgaccggcagagagcactgcagccctcaccacacagccattagacaggccctcgtgtgctgggacgagctgacaaaactgatcgcctggatgagcagcaacatcaccagcgagcaagtgcggaccatcatcgtgaaccacgtgaacgatacctggggcctgaaagtgcggcagagcctgtggtttcacctgagctgtctgaccttcggccagcacaccgtgcaagagtttctggtgtccttcggcgtgtggatcagaacccctgctccatacagacctccaaacgctcccatcctgagcaccctgcctgagcacacagtgatctgttga

SEQ ID NO: 12204 - RNA, 4094 nt, synthetic construct
  misc_feature 1..4094: note = SARS-CoV-2/Wuhan/WIV05/2019__EPI_ISL_402128 spike protein mRNA wt (1-1273)
  source 1..4094: mol_type = other RNA
aggagagtcccgcagtcggcgtccagcggctctgcttgttcgtgtgtgtgtcgttgcaggccttattcaagcttaccatgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcaggatgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12205 - RNA, 4082 nt, synthetic construct
  misc_feature 1..4082: note = SARS-CoV-2/bat/Yunnan/RaTG13/2013__EPI_ISL_402131 spike protein mRNA wt (1-1269)
  source 1..4082: mol_type = other RNA
aggagagtcccgcagtcggcgtccagcggctctgcttgttcgtgtgtgtgtcgttgcaggccttattcaagcttaccatgtttgtttttcttgttttattgccactagtttctagtcagtgtgttaatctaacaactagaactcagttacctcctgcatacaccaactcatccacccgtggtgtctattaccctgacaaagttttcagatcttcagttttacatttaactcaggatttgtttttacctttcttctccaatgtgacctggttccatgctatacatgtttcagggaccaatggtattaaaaggtttgataacccagttctgccattcaacgatggcgtctattttgcttccactgagaagtctaatataataagaggatggatttttggtactaccttagattcgaagacccagtctctacttattgttaataacgctactaatgttgttattaaagtctgtgaatttcaattttgtaatgatccatttttgggtgtttattaccacaaaaacaacaaaagttggatggaaagtgagttcagagtttactctagtgcgaataattgcacttttgagtatgtctctcagccttttcttatggaccttgaaggaaaacagggtaatttcaaaaatcttagggaattcgtgtttaagaatattgatggttatttcaaaatatattctaaacatacgcctattaatttagtgcgtgatcttccccctggtttttcagctttagaaccattggtagatctgccaataggtattaacatcactaggtttcaaactttacttgctttacatagaagctatttgactcctggtgattcttcttcaggttggacagctggtgctgcagcttattatgtgggttatcttcaaccaaggacttttctactaaaatataatgagaatggaaccattacagatgctgtagactgtgcacttgaccctctttcagaaacaaagtgtacgttaaaatccttcactgttgaaaaaggaatttatcaaacctctaactttagagtccaaccaacagattctattgttagattcccaaatattacaaacttatgtccttttggtgaagtttttaacgccaccacattcgcatcagtttatgcttggaacagaaagagaattagcaactgtgttgctgattactctgtcctatataattccacttcattttctacctttaaatgttatggagtgtctcctactaaattaaatgatctctgctttactaatgtttatgcagactcatttgtgattacaggtgatgaagtcagacaaattgcgccaggacaaactggaaagattgctgactacaattataaactaccagatgattttactggttgtgttatagcttggaattctaagcatattgatgcaaaagagggcggtaattttaactatctttaccgtctctttagaaaagctaatcttaaaccctttgagagggatatctcaactgaaatttaccaagcaggcagcaaaccttgtaatggtcaaactggtctaaattgctactacccactttatagatatggattttaccctactgatggtgttggtcaccaaccttatagggtagtagtactttcttttgaacttctaaatgcaccagcaactgtttgtggacctaagaagtctactaacttggttaaaaataaatgtgtcaatttcaactttaatggtttaactggcacaggtgtcctcacagagtctaataaaaagtttctacctttccaacaatttggtagagacattgcagacactactgatgccgtccgtgatccacagacacttgagattcttgacattacaccatgttcttttggtggtgtcagtgttataacacctggaacaaatgcctctaaccaggttgctgttctttatcaggatgttaactgcacagaagtccctgttgctatccatgcagaccaacttactcccacttggcgtgtttactccacaggttctaatgtttttcaaacacgtgcaggttgtttaataggggctgaacatgtcaataactcgtatgagtgtgacatacctattggtgcaggaatatgcgccagttatcagactcaaactaattcacgtagtgtggccagtcaatctattattgcctacactatgtcacttggtgcagaaaattcagttgcttattctaataactctattgccatacctacaaattttactattagtgtgaccactgaaattctacctgtgtctatgacaaagacatcggtagactgtacaatgtatatttgtggtgattcaactgagtgcagcaaccttttgttgcaatatggtagtttttgcacacaattaaatcgtgctttaactggaatagctgttgaacaggacaaaaatactcaagaagtttttgctcaagttaaacaaatttataagacaccaccaattaaagattttggtggtttcaatttttcacaaatattaccagatccatcaaaaccaagcaagaggtcatttattgaggatttacttttcaataaagtgacacttgctgatgctggcttcatcaaacaatatggtgattgccttggtgatattgctgctagggatcttatttgtgctcaaaagttcaatggccttactgttctgccacctttgctcacagatgaaatgatcgctcaatacacttctgcactattagcaggtacaatcacttctggttggacttttggtgcaggtgctgctttacaaataccatttgccatgcaaatggcttataggtttaatggtattggagttacacagaatgttctctatgagaaccaaaaattgattgccaaccagtttaatagtgctattggcaaaattcaagactcactttcttctacagcaagtgcacttggaaaacttcaagatgttgtcaaccaaaatgcacaagctttaaacacgcttgttaaacaacttagctccaattttggagctatttctagcgtgttaaatgatatcctttcacgtctcgacaaagttgaggctgaagtgcagattgacaggttgatcacaggcagacttcaaagcttgcagacatatgtgactcaacaattaattagagctgcagaaatcagagcttctgccaatcttgctgctactaaaatgtcagagtgtgtactcggacaatcaaaaagagttgatttttgtggaaaaggctatcatcttatgtctttccctcagtcagcacctcatggtgtagtcttcttgcatgtgacatatgtccctgcacaagaaaagaacttcacaactgctcctgccatttgtcatgatggaaaagcacactttccacgtgaaggtgttttcgtttcaaatggcacacactggtttgttacacaaaggaatttttatgaaccacaaattattacaacagacaacacatttgtctctggtagctgtgatgttgtaataggaattgtcaacaacacagtttatgatcctttgcaaccagaacttgattcattcaaggaggagttggataaatactttaaaaatcatacatcacctgatgtagatttaggtgacatttctggcattaatgcttcagttgtcaatattcaaaaggaaattgaccgcctcaatgaggttgccaaaaatctaaatgaatctctcatcgatctccaagaacttggaaagtatgaacagtatataaaatggccatggtacatttggctaggttttatagctggcttgattgccataataatggtcacgattatgctttgctgtatgaccagttgctgcagttgtctcaagggctgttgttcttgcggatcttgctgcaaatttgatgaagacgactctgagccagtgctcaaaggagtcaaattacattacacataaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12206 - RNA, 4094 nt, synthetic construct
  misc_feature 1..4094: note = SARS-CoV-2/Wuhan/HBCDC-HB-01/2019__EPI_ISL_402132 spike protein mRNA wt (1-1273)
  source 1..4094: mol_type = other RNA
aggagagtcccgcagtcggcgtccagcggctctgcttgttcgtgtgtgtgtcgttgcaggccttattcaagcttaccatgtttgtttttcttgttttattgccactagtctctagtcagtgtgttaatcttacaaccagaactcaattaccccctgcatacactaattctatcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcaggatgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12207 - RNA, 4094 nt, synthetic construct
  misc_feature 1..4094: note = SARS-CoV-2/Guangdong/20SF028/2020__EPI_ISL_403936 spike protein mRNA wt (1-1273)
  source 1..4094: mol_type = other RNA
aggagagtcccgcagtcggcgtccagcggctctgcttgttcgtgtgtgtgtcgttgcaggccttattcaagcttaccatgtttgtttttcttgttttattgccactagtctctagtcagtgtgttaatcttacaaccagaactcaattaccccctgcatacactaattctttcacacgtggtgtttattaccctgacaaagttttcagatcctcagttttatattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcaggatgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12208 - RNA, 4094 nt, synthetic construct
  misc_feature 1..4094: note = SARS-CoV-2/Shenzhen/SZTH-001/2020__EPI_ISL_406592 spike protein mRNA wt (1-1273)
  source 1..4094: mol_type = other RNA
aggagagtcccgcagtcggcgtccagcggctctgcttgttcgtgtgtgtgtcgttgcaggccttattcaagcttaccatgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcaggatgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttctaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgggccagtgctcaaaggagtcaaattacattacacataaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12209 - RNA, 4094 nt, synthetic construct
  misc_feature 1..4094: note = SARS-CoV-2/Shenzhen/SZTH-004/2020__EPI_ISL_406595 spike protein mRNA wt (1-1273)
  source 1..4094: mol_type = other RNA
aggagagtcccgcagtcggcgtccagcggctctgcttgttcgtgtgtgtgtcgttgcaggccttattcaagcttaccatgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttgggacaggaagagaatcagcaactgtgttgcttattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcaggatgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggcatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12210 - RNA, 4094 nt, synthetic construct
  misc_feature 1..4094: note = SARS-CoV-2/France/IDF0372/2020__EPI_ISL_406596 spike protein mRNA wt (1-1273)
  source 1..4094: mol_type = other RNA
aggagagtcccgcagtcggcgtccagcggctctgcttgttcgtgtgtgtgtcgttgcaggccttattcaagcttaccatgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctttcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcaggatgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12211 - RNA, 4094 nt, synthetic construct
  misc_feature 1..4094: note = SARS-CoV-2/Australia/VIC01/2020__EPI_ISL_406844 spike protein mRNA wt (1-1273)
  source 1..4094: mol_type = other RNA
aggagagtcccgcagtcggcgtccagcggctctgcttgttcgtgtgtgtgtcgttgcaggccttattcaagcttaccatgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaaggtatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcaggatgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12212 - RNA, 4094 nt, synthetic construct
  misc_feature 1..4094: note = SARS-CoV-2/Germany/BavPat1/2020__EPI_ISL_406862 spike protein mRNA wt (1-1273)
  source 1..4094: mol_type = other RNA
aggagagtcccgcagtcggcgtccagcggctctgcttgttcgtgtgtgtgtcgttgcaggccttattcaagcttaccatgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcagggtgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12213 - RNA, 4094 nt, synthetic construct
  misc_feature 1..4094: note = SARS-CoV-2/Wuhan/HBCDC-HB-02/2020__EPI_ISL_412978 spike protein mRNA wt (1-1273)
  source 1..4094: mol_type = other RNA
aggagagtcccgcagtcggcgtccagcggctctgcttgttcgtgtgtgtgtcgttgcaggccttattcaagcttaccatgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcaggatgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaattttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12214 - RNA, 4094 nt, synthetic construct
  misc_feature 1..4094: note = SARS-CoV-2/Australia/QLD02/2020__EPI_ISL_407896 spike protein mRNA wt (1-1273)
  source 1..4094: mol_type = other RNA
aggagagtcccgcagtcggcgtccagcggctctgcttgttcgtgtgtgtgtcgttgcaggccttattcaagcttaccatgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcaggatgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacttgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12215 - RNA, 4094 nt, synthetic construct
  misc_feature 1..4094: note = SARS-CoV-2/India/1-31/2020__EPI_ISL_413523 spike protein mRNA wt (1-1273)
  source 1..4094: mol_type = other RNA
aggagagtcccgcagtcggcgtccagcggctctgcttgttcgtgtgtgtgtcgttgcaggccttattcaagcttaccatgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcaggatgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgttattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12216 - RNA, 4094 nt, synthetic construct
  misc_feature 1..4094: note SARS-CoV-2/Guangdong/GD2020087-P0008/2020__EPI_ISL_413863 spike protein mRNA wt (1-1273)
  source 1..4094: mol_type = other RNA
aggagagtcccgcagtcggcgtccagcggctctgcttgttcgtgtgtgtgtcgttgcaggccttattcaagcttaccatgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagagaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcaggatgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12217 - RNA, 4094 nt, synthetic construct
  misc_feature 1..4094: note = SARS-CoV-2/Sweden/01/2020__EPI_ISL_411951 spike protein mRNA wt (1-1273)
  source 1..4094: mol_type = other RNA
aggagagtcccgcagtcggcgtccagcggctctgcttgttcgtgtgtgtgtcgttgcaggccttattcaagcttaccatgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcaggatgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattgtggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12218 - RNA, 4094 nt, synthetic construct
  misc_feature 1..4094: note = SARS-CoV-2/Tianmen/HBCDC-HB-07/2020__EPI_ISL_412983 spike protein mRNA wt (1-1273)
  source 1..4094: mol_type = other RNA
aggagagtcccgcagtcggcgtccagcggctctgcttgttcgtgtgtgtgtcgttgcaggccttattcaagcttaccatgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcaggatcttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12219 - RNA, 4094 nt, synthetic construct
  misc_feature 1..4094: note = SARS-CoV-2/Hong Kong/case42_VM20002493/2020__EPI_ISL_414527 spike protein mRNA wt (1-1273)
  source 1..4094: mol_type = other RNA
aggagagtcccgcagtcggcgtccagcggctctgcttgttcgtgtgtgtgtcgttgcaggccttattcaagcttaccatgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcaggatgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttgctattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12220 - RNA, 4094 nt, synthetic construct
  misc_feature 1..4094: note = SARS-CoV-2/USA/CruiseA-23/2020__EPI_ISL_414482 spike protein mRNA wt (1-1273)
  source 1..4094: mol_type = other RNA
aggagagtcccgcagtcggcgtccagcggctctgcttgttcgtgtgtgtgtcgttgcaggccttattcaagcttaccatgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaagtaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcaggatgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12221 - RNA, 4094 nt, synthetic construct
  misc_feature 1..4094: note = SARS-CoV-2/Hong Kong/case85_VM20002868/2020__EPI_ISL_414519 spike protein mRNA wt (1-1273)
  source 1..4094: mol_type = other RNA
aggagagtcccgcagtcggcgtccagcggctctgcttgttcgtgtgtgtgtcgttgcaggccttattcaagcttaccatgtttgtttttcttgttttagtgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcaggatgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12222 - RNA, 4094 nt, synthetic construct
  misc_feature 1..4094: note = SARS-CoV-2/England/200990660/2020__EPI_ISL_414523 spike protein mRNA wt (1-1273)
  source 1..4094: mol_type = other RNA
aggagagtcccgcagtcggcgtccagcggctctgcttgttcgtgtgtgtgtcgttgcaggccttattcaagcttaccatgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcagggtgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagctagtgctcaaaggagtcaaattacattacacataaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12223 - RNA, 4094 nt, synthetic construct
  misc_feature 1..4094: note = SARS-CoV-2/Australia/NSW09/2020__EPI_ISL_413595 spike protein mRNA wt (1-1273)
  source 1..4094: mol_type = other RNA
aggagagtcccgcagtcggcgtccagcggctctgcttgttcgtgtgtgtgtcgttgcaggccttattcaagcttaccatgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcaggatgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttctttcacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12224 - RNA, 4094 nt, synthetic construct
  misc_feature 1..4094: note = SARS-CoV-2/Australia/NSW10/2020__EPI_ISL_413596 spike protein mRNA wt (1-1273)
  source 1..4094: mol_type = other RNA
aggagagtcccgcagtcggcgtccagcggctctgcttgttcgtgtgtgtgtcgttgcaggccttattcaagcttaccatgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcaggatgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgcttcaaatttgatgaagacgactctgagccagtgctcaaaggagtcaaattacattacacataaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12225 - RNA, 4094 nt, synthetic construct
  misc_feature 1..4094: note SARS-CoV-2/Switzerland/1000477797/2020__EPI_ISL_413023 spike protein mRNA wt (1-1273)
  source 1..4094: mol_type = other RNA
aggagagtcccgcagtcggcgtccagcggctctgcttgttcgtgtgtgtgtcgttgcaggccttattcaagcttaccatgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaacatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcagggtgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12226 - RNA, 4094 nt, synthetic construct
  misc_feature 1..4094: note = SARS-CoV-2/Belgium/BA-02291/2020__EPI_ISL_415159 spike protein mRNA wt (1-1273)
  source 1..4094: mol_type = other RNA
aggagagtcccgcagtcggcgtccagcggctctgcttgttcgtgtgtgtgtcgttgcaggccttattcaagcttaccatgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaggtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacctgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcagggtgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttctgcagcacctgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12227 - RNA, 4094 nt, synthetic construct
  misc_feature 1..4094: note = SARS-CoV-2/USA/WA8-UW5/2020__EPI_ISL_413486 spike protein mRNA wt (1-1273)
  source 1..4094: mol_type = other RNA
aggagagtcccgcagtcggcgtccagcggctctgcttgttcgtgtgtgtgtcgttgcaggccttattcaagcttaccatgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcaggatgttaactgcacagaagtccctgttgctattcatgcagatcaacttactcctacttggcgtgtttattctacaggttctaatgtttttcaaacacgtgcaggctgtttaataggggctgaatatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12228 - RNA, 4094 nt, synthetic construct
  misc_feature 1..4094: note = SARS-CoV-2/England/20102000506/2020__EPI_ISL_415147 spike protein mRNA wt (1-1273)
  source 1..4094: mol_type = other RNA
aggagagtcccgcagtcggcgtccagcggctctgcttgttcgtgtgtgtgtcgttgcaggccttattcaagcttaccatgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcagggtgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggttattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12229 - RNA, 4094 nt, synthetic construct
  misc_feature 1..4094: note = SARS-CoV-2/Belgium/VAG-03013/2020__EPI_ISL_415155 spike protein mRNA wt (1-1273)
  source 1..4094: mol_type = other RNA
aggagagtcccgcagtcggcgtccagcggctctgcttgttcgtgtgtgtgtcgttgcaggccttattcaagcttaccatgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcagggtgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaactgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12230 - RNA, 4094 nt, synthetic construct
  misc_feature 1..4094: note = SARS-CoV-2/Belgium/BC-03016/2020__EPI_ISL_415157 spike protein mRNA wt (1-1273)
  source 1..4094: mol_type = other RNA
aggagagtcccgcagtcggcgtccagcggctctgcttgttcgtgtgtgtgtcgttgcaggccttattcaagcttaccatgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcagggtgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcacctgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12231 - RNA, 4094 nt, synthetic construct
  misc_feature 1..4094: note = SARS-CoV-2/Germany/BavPat3/2020__EPI_ISL_414521 spike protein mRNA wt (1-1273)
  source 1..4094: mol_type = other RNA
aggagagtcccgcagtcggcgtccagcggctctgcttgttcgtgtgtgtgtcgttgcaggccttattcaagcttaccatgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcaggatgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaacaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12232 - RNA, 4094 nt, synthetic construct
  misc_feature 1..4094: note = SARS-CoV-2/France/HF1805/2020__EPI_ISL_414628 spike protein mRNA wt (1-1273)
  source 1..4094: mol_type = other RNA
aggagagtcccgcagtcggcgtccagcggctctgcttgttcgtgtgtgtgtcgttgcaggccttattcaagcttaccatgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcagggtgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggagttgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12233 - RNA, 4094 nt, synthetic construct
  misc_feature 1..4094: note SARS-CoV-2/Netherlands/ZuidHolland_9/2020__EPI_ISL_414445 spike protein mRNA wt (1-1273)
  source 1..4094: mol_type = other RNA
aggagagtcccgcagtcggcgtccagcggctctgcttgttcgtgtgtgtgtcgttgcaggccttattcaagcttaccatgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcagggtgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgtacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12234 - RNA, 4094 nt, synthetic construct
  misc_feature 1..4094: note = SARS-CoV-2/Finland/FIN03032020A/2020__EPI_ISL_413602 spike protein mRNA wt (1-1273)
  source 1..4094: mol_type = other RNA
aggagagtcccgcagtcggcgtccagcggctctgcttgttcgtgtgtgtgtcgttgcaggccttattcaagcttaccatgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatatcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcagggtgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12235 - RNA, 4094 nt, synthetic construct
  misc_feature 1..4094: note = SARS-CoV-2/France/GE1977/2020__EPI_ISL_414632 spike protein mRNA wt (1-1273)
  source 1..4094: mol_type = other RNA
aggagagtcccgcagtcggcgtccagcggctctgcttgttcgtgtgtgtgtcgttgcaggccttattcaagcttaccatgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcagggtgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcacttttttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12236 - RNA, 4094 nt, synthetic construct
  misc_feature 1..4094: note = SARS-CoV-2/Finland/FIN-313/2020__EPI_ISL_414641 spike protein mRNA wt (1-1273)
  source 1..4094: mol_type = other RNA
aggagagtcccgcagtcggcgtccagcggctctgcttgttcgtgtgtgtgtcgttgcaggccttattcaagcttaccatgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttaaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcagggtgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatctatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12237 - RNA, 4094 nt, synthetic construct
  misc_feature 1..4094: note SARS-CoV-2/Netherlands/ZuidHolland_2/2020__EPI_ISL_414556 spike protein mRNA wt (1-1273)
  source 1..4094: mol_type = other RNA
aggagagtcccgcagtcggcgtccagcggctctgcttgttcgtgtgtgtgtcgttgcaggccttattcaagcttaccatgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcagggtgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctcttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12238 - RNA, 4094 nt, synthetic construct
  misc_feature 1..4094: note = SARS-CoV-2/USA/WA-UW31/2020__EPI_ISL_414618 spike protein mRNA wt (1-1273)
  source 1..4094: mol_type = other RNA
aggagagtcccgcagtcggcgtccagcggctctgcttgttcgtgtgtgtgtcgttgcaggccttattcaagcttaccatgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgctgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcaggatgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12239 - RNA, 4094 nt, synthetic construct
  misc_feature 1..4094: note = SARS-CoV-2/South Korea/SNU01/2020__EPI_ISL_411929 spike protein mRNA wt (1-1273)
  source 1..4094: mol_type = other RNA
aggagagtcccgcagtcggcgtccagcggctctgcttgttcgtgtgtgtgtcgttgcaggccttattcaagcttaccatgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttgggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcaggatgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12240 - RNA, 4094 nt, synthetic construct
  misc_feature 1..4094: note = SARS-CoV-2/China/WF0004/2020__EPI_ISL_413694 spike protein mRNA wt (1-1273)
  source 1..4094: mol_type = other RNA
aggagagtcccgcagtcggcgtccagcggctctgcttgttcgtgtgtgtgtcgttgcaggccttattcaagcttaccatgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggacggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcaggatgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagatttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12241 - RNA, 4094 nt, synthetic construct
  misc_feature 1..4094: note = SARS-CoV-2/China/WF0028/2020__EPI_ISL_413791 spike protein mRNA wt (1-1273)
  source 1..4094: mol_type = other RNA
aggagagtcccgcagtcggcgtccagcggctctgcttgttcgtgtgtgtgtcgttgcaggccttattcaagcttaccatgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcaggatgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagaatcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12242 - RNA, 4094 nt, synthetic construct
  misc_feature 1..4094: note = SARS-CoV-2/2019-nCoV/USA-CruiseA-18/2020__MT159716.1 spike protein mRNA wt (1-1273)
  source 1..4094: mol_type = other RNA
aggagagtcccgcagtcggcgtccagcggctctgcttgttcgtgtgtgtgtcgttgcaggccttattcaagcttaccatgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttaagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcaggatgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12243 - RNA, 4094 nt, synthetic construct
  misc_feature 1..4094: note SARS-CoV-2/SARS-CoV-2/Yunnan-01/human/2020/CHN__MT049951.1 spike protein mRNA wt (1-1273)
  source 1..4094: mol_type = other RNA
aggagagtcccgcagtcggcgtccagcggctctgcttgttcgtgtgtgtgtcgttgcaggccttattcaagcttaccatgtttgtttttcttgttttattgccactagtctctagtcagtgtgttaatcttacaaccagaactcaattaccccctgcaaacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcaggatgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12244 - RNA, 4094 nt, synthetic construct
  misc_feature 1..4094: note = SARS-CoV-2/USA/WA-UW292/2020__EPI_ISL_418077 spike protein mRNA wt (1-1273)
  source 1..4094: mol_type = other RNA
aggagagtcccgcagtcggcgtccagcggctctgcttgttcgtgtgtgtgtcgttgcaggccttattcaagcttaccatgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccagtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcaggatgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12245 - RNA, 4094 nt, synthetic construct
  misc_feature 1..4094: note = SARS-CoV-2/Iceland/192/2020__EPI_ISL_417819 spike protein mRNA wt (1-1273)
  source 1..4094: mol_type = other RNA
aggagagtcccgcagtcggcgtccagcggctctgcttgttcgtgtgtgtgtcgttgcaggccttattcaagcttaccatgtttgttttttttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcagggtgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12246 - RNA, 4094 nt, synthetic construct
  misc_feature 1..4094: note = SARS-CoV-2/Belgium/ULG-6939/2020__EPI_ISL_417020 spike protein mRNA wt (1-1273)
  source 1..4094: mol_type = other RNA
aggagagtcccgcagtcggcgtccagcggctctgcttgttcgtgtgtgtgtcgttgcaggccttattcaagcttaccatgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcagggtgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgtttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12247 - RNA, 4094 nt, synthetic construct
  misc_feature 1..4094: note = SARS-CoV-2/France/HF2496/2020__EPI_ISL_418231 spike protein mRNA wt (1-1273)
  source 1..4094: mol_type = other RNA
aggagagtcccgcagtcggcgtccagcggctctgcttgttcgtgtgtgtgtcgttgcaggccttattcaagcttaccatgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcagggtgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgttgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12248 - RNA, 4094 nt, synthetic construct
  misc_feature 1..4094: note = SARS-CoV-2/USA/WA-UW291/2020__EPI_ISL_418076 spike protein mRNA wt (1-1273)
  source 1..4094: mol_type = other RNA
aggagagtcccgcagtcggcgtccagcggctctgcttgttcgtgtgtgtgtcgttgcaggccttattcaagcttaccatgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcagggtgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaatactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12249 - RNA, 4094 nt, synthetic construct
  misc_feature 1..4094: note = SARS-CoV-2/Portugal/PT0034/2020__EPI_ISL_418019 spike protein mRNA wt (1-1273)
  source 1..4094: mol_type = other RNA
aggagagtcccgcagtcggcgtccagcggctctgcttgttcgtgtgtgtgtcgttgcaggccttattcaagcttaccatgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcagggtgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtattaccagttgctgtagttgtctcaagggctgttgttcttgtggatcctgctgcaaatttgatgaagacgactctgagccagtgctcaaaggagtcaaattacattacacataaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12250 - RNA, 4094 nt, synthetic construct
  misc_feature 1..4094: note = SARS-CoV-2/Iceland/202/2020__EPI_ISL_417750 spike protein mRNA wt (1-1273)
  source 1..4094: mol_type = other RNA
aggagagtcccgcagtcggcgtccagcggctctgcttgttcgtgtgtgtgtcgttgcaggccttattcaagcttaccatgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcaggatgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatccctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12251 - RNA, 4094 nt, synthetic construct
  misc_feature 1..4094: note = SARS-CoV-2/USA/WA-UW261/2020__EPI_ISL_418046 spike protein mRNA wt (1-1273)
  source 1..4094: mol_type = other RNA
aggagagtcccgcagtcggcgtccagcggctctgcttgttcgtgtgtgtgtcgttgcaggccttattcaagcttaccatgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttacatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcaggatgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12252 - RNA, 4094 nt, synthetic construct
  misc_feature 1..4094: note = SARS-CoV-2/Portugal/PT0035/2020__EPI_ISL_418020 spike protein mRNA wt (1-1273)
  source 1..4094: mol_type = other RNA
aggagagtcccgcagtcggcgtccagcggctctgcttgttcgtgtgtgtgtcgttgcaggccttattcaagcttaccatgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcaggatgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatatttctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12253 - RNA, 4094 nt, synthetic construct
  misc_feature 1..4094: note = SARS-CoV-2/USA/NY-NYUMC7/2020__EPI_ISL_418192 spike protein mRNA wt (1-1273)
  source 1..4094: mol_type = other RNA
aggagagtcccgcagtcggcgtccagcggctctgcttgttcgtgtgtgtgtcgttgcaggccttattcaagcttaccatgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttatcaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcagggtgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12254 - RNA, 4094 nt, synthetic construct
  misc_feature 1..4094: note = SARS-CoV-2/Iceland/189/2020__EPI_ISL_417709 spike protein mRNA wt (1-1273)
  source 1..4094: mol_type = other RNA
aggagagtcccgcagtcggcgtccagcggctctgcttgttcgtgtgtgtgtcgttgcaggccttattcaagcttaccatgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcagggtgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcaccaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12255 - RNA, 4094 nt, synthetic construct
  misc_feature 1..4094: note = SARS-CoV-2/Australia/NSW56/2020__EPI_ISL_417408 spike protein mRNA wt (1-1273)
  source 1..4094: mol_type = other RNA
aggagagtcccgcagtcggcgtccagcggctctgcttgttcgtgtgtgtgtcgttgcaggccttattcaagcttaccatgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcaggatgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagattcatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12256 - RNA, 4094 nt, synthetic construct
  misc_feature 1..4094: note = SARS-CoV-2/Iceland/280/2020__EPI_ISL_417608 spike protein mRNA wt (1-1273)
  source 1..4094: mol_type = other RNA
aggagagtcccgcagtcggcgtccagcggctctgcttgttcgtgtgtgtgtcgttgcaggccttattcaagcttaccatgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcagggtgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcatactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12257 - RNA, 4094 nt, synthetic construct
  misc_feature 1..4094: note = SARS-CoV-2/Iceland/247/2020__EPI_ISL_417575 spike protein mRNA wt (1-1273)
  source 1..4094: mol_type = other RNA
aggagagtcccgcagtcggcgtccagcggctctgcttgttcgtgtgtgtgtcgttgcaggccttattcaagcttaccatgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcagggtgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaattgtgacaattatgctttgctgtatgaccagttgctgtagttgtctcaagggctgttgttcttgtggatcctgctgcaaatttgatgaagacgactctgagccagtgctcaaaggagtcaaattacattacacataaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12258 - RNA, 4094 nt, synthetic construct
  misc_feature 1..4094: note = SARS-CoV-2/Iceland/238/2020__EPI_ISL_417566 spike protein mRNA wt (1-1273)
  source 1..4094: mol_type = other RNA
aggagagtcccgcagtcggcgtccagcggctctgcttgttcgtgtgtgtgtcgttgcaggccttattcaagcttaccatgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcagggtgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgttggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12259 - RNA, 4094 nt, synthetic construct
  misc_feature 1..4094: note = SARS-CoV-2/Greece/16/2020__EPI_ISL_418265 spike protein mRNA wt (1-1273)
  source 1..4094: mol_type = other RNA
aggagagtcccgcagtcggcgtccagcggctctgcttgttcgtgtgtgtgtcgttgcaggccttattcaagcttaccatgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatgttgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcaggatgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12260 - RNA, 4094 nt, synthetic construct
  misc_feature 1..4094: note = SARS-CoV-2/Iceland/319/2020__EPI_ISL_417648 spike protein mRNA wt (1-1273)
  source 1..4094: mol_type = other RNA
aggagagtcccgcagtcggcgtccagcggctctgcttgttcgtgtgtgtgtcgttgcaggccttattcaagcttaccatgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatagaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcagggtgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12261 - RNA, 4094 nt, synthetic construct
  misc_feature 1..4094: note = SARS-CoV-2/Congo/94/2020__EPI_ISL_417947 spike protein mRNA wt (1-1273)
  source 1..4094: mol_type = other RNA
aggagagtcccgcagtcggcgtccagcggctctgcttgttcgtgtgtgtgtcgttgcaggccttattcaagcttaccatgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcagggtgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatatacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12262 - RNA, 4094 nt, synthetic construct
  misc_feature 1..4094: note = SARS-CoV-2/Congo/158/2020__EPI_ISL_417950 spike protein mRNA wt (1-1273)
  source 1..4094: mol_type = other RNA
aggagagtcccgcagtcggcgtccagcggctctgcttgttcgtgtgtgtgtcgttgcaggccttattcaagcttaccatgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcaggatgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttttgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12263 - RNA, 4094 nt, synthetic construct
  misc_feature 1..4094: note = SARS-CoV-2/USA/UT-00034/2020__EPI_ISL_417977 spike protein mRNA wt (1-1273)
  source 1..4094: mol_type = other RNA
aggagagtcccgcagtcggcgtccagcggctctgcttgttcgtgtgtgtgtcgttgcaggccttattcaagcttaccatgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattactacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcagggtgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12264 - RNA, 4094 nt, synthetic construct
  misc_feature 1..4094: note = SARS-CoV-2/USA/UT-00033/2020__EPI_ISL_417976 spike protein mRNA wt (1-1273)
  source 1..4094: mol_type = other RNA
aggagagtcccgcagtcggcgtccagcggctctgcttgttcgtgtgtgtgtcgttgcaggccttattcaagcttaccatgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggtttgacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcagggtgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12265 - RNA, 4094 nt, synthetic construct
  misc_feature 1..4094: note = SARS-CoV-2/USA/WI-13/2020__EPI_ISL_417516 spike protein mRNA wt (1-1273)
  source 1..4094: mol_type = other RNA
aggagagtcccgcagtcggcgtccagcggctctgcttgttcgtgtgtgtgtcgttgcaggccttattcaagcttaccatgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtcctaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcagggtgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12266 - RNA, 4091 nt, synthetic construct
  misc_feature 1..4091: note = SARS-CoV-2/India/1-27/2020__EPI_ISL_413522 spike protein mRNA wt (1-1272)
  source 1..4091: mol_type = other RNA
aggagagtcccgcagtcggcgtccagcggctctgcttgttcgtgtgtgtgtcgttgcaggccttattcaagcttaccatgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcatacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcaggatgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12267 - RNA, 4076 nt, synthetic construct
  misc_feature 1..4076: note = SARS-CoV-2/pangolin/Guangxi/P4L/2017__EPI_ISL_410538 spike protein mRNA wt (1-1267)
  source 1..4076: mol_type = other RNA
aggagagtcccgcagtcggcgtccagcggctctgcttgttcgtgtgtgtgtcgttgcaggccttattcaagcttaccatgtttgtttttctttttgtcttgcctttggtttccagtcaatgtgtcaatttgaccacaagaactggaataccgccaggttataccaattcatctactagaggtgtctattatccagacaaagtttttaggtcttcaattttacatcttacacaagaccttttcttacctttcttttctaatgttacttggtttaacaccataaattatcaaggaggctttaagaagtttgacaatcctgttttaccatttaatgatggtgtttactttgcctccacggaaaagtccaatattatacgcggttggatttttggaacaacacttgatgccagaactcaatctcttctaatagttaacaacgcaaccaatgttgttatcaaagtatgtgagtttcagttttgcactgatccatttttaggtgtttactatcataacaacaataaaacatgggttgaaaatgagtttagagtttattcaagtgccaacaattgcactttcgaatacatttctcaaccttttcttatggaccttgaaggaaagcaaggtaattttaagaaccttagagagtttgtgtttaaaaatgttgatggttatttcaagatttactctaaacacacacctattgatttagtgcgcgacctccccagaggttttgctgcattggaaccactggtggacctccctataggtattaatattaccagattccaaacattgcttgctttacatagaagttatcttacacctggtaatctagaaagtggctggacaactggagctgctgcttactatgtaggttacctacaacagaggacttttctcttaagttacaatcaaaatggaaccattacagatgctgttgattgttcactagaccctctttcagagacaaagtgcacattaaaatccctaacagttgaaaaaggaatttaccagacttctaacttcagagttcaaccaacaatcagtatagttagatttcctaatattacaaacttatgtccatttggagaagtgtttaacgcatccaaatttgcatcagtttatgcttggaacaggaagagaattagcaattgtgttgctgattactctgtactttataactctacatcattttccacttttaaatgttatggagtttcacctacaaaactcaatgacctttgcttcaccaatgtgtatgcagactcatttgttgttaaaggtgacgaggttagacaaatagcacccggacaaactggtgttattgctgattataactataagctgccagatgattttactggttgtgttattgcttggaactcagttaagcaagatgctttgactggtggtaattatggttatttgtatagattatttagaaagtctaagcttaaaccatttgagagagatatttccactgaaatataccaagccggcagcacaccctgtaacggtcaagttggtctaaattgttattatcctcttgaaaggtatggttttcacccaactacaggtgttaactaccaaccttttagagtggttgttttatcatttgagttacttaatggaccagctactgtttgtggacccaaattgtctacaacactagttaaagacaaatgtgtcaatttcaactttaacggtttaactggcacaggtgttcttacaacatctaagaaacagtttctgccttttcaacaatttggtagagacatctctgacactactgatgctgtccgtgacccacagacacttgaaatacttgacattaccccttgctcttttggaggagttagtgtgataacaccaggtacaaacacttctaatcaagtggctgtactttaccaagatgttaactgtactgaagtgcctatggccattcatgcagaacaacttacacctgcctggcgtgtttactctgcaggagcaaatgtgtttcaaacaagagcaggctgtttagtaggtgctgagcatgtcaacaattcttatgaatgtgacattccagtcggtgctggcatatgtgcaagttaccattccatgtcatcattgcgtagtgtcaaccagcgttcaatcattgcttacactatgtctttaggtgcagaaaattcagttgcttattctaataattcaattgccatacctactaattttacaataagtgttaccacagaaattctaccagtgtcaatgactaagacttctgtagattgtactatgtacatctgtggagattcaattgagtgtagtaatttattgctacaatatggcagtttttgcacacaattaaaccgtgctttgactgggattgctgttgaacaagacaaaaacacacaagaagtttttgcccaggttaaacaaatctacaaaacaccacctattaaagattttggtggctttaacttttcacaaatattgccagatccatcaaaaccaagcaagaggtcatttattgaggatttactcttcaacaaagtgacacttgctgatgctggcttcatcaaacaatatggtgattgccttggtgatattgctgctagagatctcatctgtgcacaaaagttcaatggactcacggttctaccgcctttgctcacagatgaaatgattgctcaatacacttctgcactacttgctggaacaatcacctcaggttggacctttggtgcaggagctgctttacaaataccctttgcaatgcaaatggcttacaggtttaatggcattggagtcactcagaatgttctatatgagaatcagaaattaattgccaatcagttcaacagtgctattggcaaaatacaggattcactttcatctacggctagtgcacttggtaaacttcaagacgtcgtaaatcaaaatgcacaggctttaaacacacttgtcaaacaacttagttccaattttggagctatttcgagtgtgcttaatgatattctttcacgtcttgacaaagttgaggctgaagtgcaaattgataggttaatcacaggaagactacagagtcttcaaacttatgtgacacaacaattaatcagagcagcagaaatcagagcttctgctaatcttgctgcaacaaaaatgtctgagtgcgtactcggacaatctaaaagagttgatttttgtggaaaaggctaccatttaatgtctttccctcaatcagcaccgcatggtgttgttttcttgcatgttacttatgtacctgcacaagaaaagaactttactactgctcctgctatttgtcatgaaggaaaagcacacttccctcgtgaaggtgtcttcgtttcaaatggcactcattggtttattacacaaaggaatttttatgaacctcaaattattaccactgacaacacattcgtctctggtagctgtgatgttgtaattggaatagtcaacaacacagtttatgatcctttgcaacccgagcttgactcatttaaggaggagttagacaaatacttcaaaaatcacacatcaccagatgttgatcttggcgacatatctggcataaatgcttcggtcgtcaacatacaaaaagaaattgaccgcctcaatgaggttgccaaaaatttgaatgaatcacccattgacctacaagagcttggaaaatatgagcaatacatcaaatggccttggtacatttggcttggttttatagctgggctaattgctatcattatggtcacaatcatgctatgttgtatgactagttgctgtagttgcctcaagggttgttgctcttgcggttcctgctgcaaatttgatgaagacgattcagaacctgttctgaaaggagtcaaattacattacacataaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12268 - RNA, 4076 nt, synthetic construct
  misc_feature 1..4076: note = SARS-CoV-2/pangolin/Guangxi/P5L/2017__EPI_ISL_410540 spike protein mRNA wt (1-1267)
  source 1..4076: mol_type = other RNA
aggagagtcccgcagtcggcgtccagcggctctgcttgttcgtgtgtgtgtcgttgcaggccttattcaagcttaccatgtttgtttttctttttgtcttgcctttggtttccagtcaatgtgtcaatttgaccacaagaactggaataccgccaggttataccaattcatctactagaggtgtctattatccagacaaagtttttaggtcttcaattttacatcttacacaagaccttttcttacctttcttttctaatgttacttggtttaacaccataaattatcaaggaggctttaagaagtttgacaatcctgttttaccatttaatgatggtgtttactttgcctccacggaaaagtccaatattatacgcggttggatttttggaacaacacttgatgccagaactcaatctcttctaatagttaacaacgcaaccaatgttgttatcaaagtatgtgagtttcagttttgcactgatccatttttaggtgtttactatcataacaacaataaaacatgggttgaaaatgagtttagagtttattcaagtgccaacaattgcactttcgaatacatttctcaaccttttcttatggaccttgaaggaaagcaaggtaattttaagaaccttagagagtttgtgtttaaaaatgttgatggttatttcaagatttactctaaacacacacctattgatttagtgcgcgacctccccagaggttttgctgcattggaaccactggtggacctccctataggtattaatattaccagattccaaacattgcttgctttacatagaagttatcttacacctggtaagctagaaagtggctggacaactggagctgctgcttactatgtaggttacctacaacagaggacttttctcttaagttacaatcaaaatggaaccattacagatgctgttgattgttcactagaccctctttcagagacaaagtgcacattaaaatccctaacagttgaaaaaggaatttaccagacttctaacttcagagttcaaccaacaatcagtatagttagatttcctaatattacaaacttatgtccatttggagaagtgtttaacgcatccaaatttgcatcagtttatgcttggaacaggaagagaattagcaattgtgttgctgattactctgtactttataactctacatcattttccacttttaaatgttatggagtttcacctacaaaactcaatgacctttgcttcaccaatgtgtatgcagactcatttgttgttaaaggtgacgaggttagacaaatagcacccggacaaactggtgttattgctgattataactataagctgccagatgattttactggttgtgttattgcttggaactcagttaagcaagatgctttgactggtggtaattatggttatttgtatagattatttagaaagtctaagcttaaaccatttgagagagatatttccactgaaatataccaagccggcagcacaccctgtaacggtcaagttggtctaaattgttattatcctcttgaaaggtatggttttcacccaactacaggtgttaactaccaaccttttagagtggttgttttatcatttgagttacttaatggaccagctactgtttgtggacccaaattgtctacaacactagttaaagacaaatgtgtcaatttcaactttaacggtttaactggcacaggtgttcttacaacatctaagaaacagtttctgccttttcaacaatttggtagagacatctctgacactactgatgctgtccgtgacccacagacacttgaaatacttgacattaccccttgctcttttggaggagttagtgtgataacaccaggtacaaacacttctaatcaagtggctgtactttaccaagatgttaactgtactgaagtgcctatggccattcatgcagaacaacttacacctgcctggcgtgtttactctgcaggagcaaatgtgtttcaaacaagagcaggctgtttagtaggtgctgagcatgtcaacaattcttatgaatgtgacattccagtcggtgctggcatatgtgcaagttaccattccatgtcatcatttcgtagtgtcaaccagcgttcaatcattgcttacactatgtctttaggtgcagaaaattcagttgcttattctaataattcaattgccatacctactaattttacaataagtgttaccacagaaattctaccagtgtcaatgactaagacttctgtagattgtactatgtacatctgtggagattcaattgagtgtagtaatttattgctacaatatggcagtttttgcacacaattaaaccgtgctttgactgggattgctgttgaacaagacaaaaacacacaagaagtttttgcccaggttaaacaaatctacaaaacaccacctattaaagattttggtggctttaacttttcacaaatattgccagatccatcaaaaccaagcaagaggtcatttattgaggatttactcttcaacaaagtgacacttgctgatgctggcttcatcaaacaatatggtgattgccttggtgatattgctgctagagatctcatctgtgcacaaaagttcaatggactcacggttctaccgcctttgctcacagatgaaatgattgctcaatacacttctgcactacttgctggaacaatcacctcaggttggacctttggtgcaggagctgctttacaaataccctttgcaatgcaaatggcttacaggtttaatggcattggagtcactcagaatgttctatatgagaatcagaaattaattgccaatcagttcaacagtgctattggcaaaatacaggattcactttcatctacggctagtgcacttggtaaacttcaagacgtcgtaaatcaaaatgcacaggctttaaacacacttgtcaaacaacttagttccaattttggagctatttcgagtgtgcttaatgatattctttcacgtcttgacaaagttgaggctgaagtgcaaattgataggttaatcacaggaagactacagagtcttcaaacttatgtgacacaacaattaatcagagcagcagaaatcagagcttctgctaatcttgctgcaacaaaaatgtctgagtgcgtactcggacaatctaaaagagttgatttttgtggaaaaggctaccatttaatgtctttccctcaatcagcaccgcatggtgttgttttcttgcatgttacttatgtacctgcacaagaaaagaactttactactgctcctgctatttgtcatgaaggaaaagcacacttccctcgtgaaggtgtcttcgtttcaaatggcactcattggtttattacacaaaggaatttttatgaacctcaaattattaccactgacaacacattcgtctctggtagctgtgatgttgtaattggaatagtcaacaacacagtttatgatcctttgcaacccgagcttgactcatttaaggaggagttagacaaatacttcaaaaatcacacatcaccagatgttgatcttggcgacatatctggcataaatgcttcggtcgtcaacatacaaaaagaaattgaccgcctcaatgaggttgccaaaaatttgaatgaatcactcattgacctacaagagcttggaaaatatgagcaatacatcaaatggccttggtacatttggcttggttttatagctgggctaattgctatcattatggtcacaatcatgctatgttgtatgactagttgctgtagttgcctcaagggttgttgctcttgcggttcctgctgcaaatttgatgaagacgattcagaacctgttctgaaaggagtcaaattacattacacataaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12269 - RNA, 4076 nt, synthetic construct
  misc_feature 1..4076: note = SARS-CoV-2/pangolin/Guangxi/P5E/2017__EPI_ISL_410541 spike protein mRNA wt (1-1267)
  source 1..4076: mol_type = other RNA
aggagagtcccgcagtcggcgtccagcggctctgcttgttcgtgtgtgtgtcgttgcaggccttattcaagcttaccatgtttgtttttctttttgtcttgcctttggtttccagtcaatgtgtcaatttgaccacaagaactggaataccgccaggttataccaattcatctactagaggtgtctattatccagacaaagtttttaggtcttcaattttacatcttacacaagaccttttcttacctttcttttctaatgttacttggtttaacaccataacttatcaaggaggctctaagaagtttgacaatcctgttttaccatttaatgatggtgtttactttgcctccacggaaaagtccaatattatacgcggttggatttttggaacaacacttgatgccagaactcaatctcttctaatagttaacaacgcaaccaatgttgttatcaaagtatgtgagtttcagttttgcactgatccatttttaggtgtttactatcataacaacaataaaacatgggttgaaaatgagtttagagtttattcaagtgccaacaattgcactttcgaatacatttctcaaccttttcttatggaccttgaaggaaagcaaggtaattttaagaaccttagagagtttgtgtttaaaaatgttgatggttatttcaagatttactctaaacacacacctattgatttagtgcgcgacctccccagaggttttgctgcattggaaccactggtggacctccctataggtattaatattaccagattccaaacattgcttgctttacatagaagttatcttacacctggtaagctagaaagtggctggacaactggagctgctgcttactatgtaggttacctacaacagaggacttttctcttaagttacaatcaaaatggaaccattacagatgctgttgattgttcactagaccctctttcagagacaaagtgcacattaaaatccctaacagttgaaaaaggaatttaccagacttctaacttcagagttcaaccaacaatcagtatagttagatttcctaatattacaaacttatgtccatttggagaagtgtttaacgcatccaaatttgcatcagtttatgcttggaacaggaagagaattagcaattgtgttgctgattactctgtactttataactctacatcattttccacttttaaatgttatggagtttcacctacaaaactcaatgacctttgcttcaccaatgtgtatgcagactcatttgttgttaaaggtgacgaggttagacaaatagcacccggacaaactggtgttattgctgattataactataagctgccagatgattttactggttgtgttattgcttggaactcagttaagcaagatgctttgactggtgataattatggttatttgtatagattatttagaaagtctaagcttaaaccatttgagagagatatttccactgaaatataccaagccggcagcacaccctgtaacggtcaagttggtctaaattgttattatcctcttgaaaggtatggttttcacccaactacaggtgttaactaccaaccttttagagtggttgttttatcatttgagttacttaatggaccagctactgtttgtggacccaaattgtctacaacactagttaaagacaaatgtgtcaatttcaactttaacggtttaactggcacaggtgttcttacaacatctaagaaacagtttctgccttttcaacaatttggtagagacatctctgacactactgatgctgtccgtgacccacagacacttgaaatacttgacattaccccttgctcttttggaggagttagtgtgataacaccaggtacaaacacttctaatcaagtggctgtactttaccaagatgttaactgtactgaagtgcctatggccattcatgcagaacaacttacacctgcctggcgtgtttactctgcaggagcaaatgtgtttcaaacaagagcaggctgtttagtaggtgctgagcatgtcaacaattcttatgaatgtgacattccagtcggtgctggcatatgtgcaagttaccattccatgtcatcatttcgtagtgtcaaccagcgttcaatcattgcttacactatgtctttaggtgcagaaaattcagttgcttattctaataattcaattgccatacctactaattttacaataagtgttaccacagaaattctaccagtgtcaatgactaagacttctgtagattgtactatgtacatctgtggagattcaattgagtgtagtaatttattgctacaatatggcagtttttgcacacaattaaaccgtgctttgactgggattgctgttgaacaagacaaaaacacacaagaagtttttgcccaggttaaacaaatctacaaaacaccacctattaaagattttggtggctttaacttttcacaaatattgccagatccatcaaaaccaagcaagaggtcatttattgaggatttactcttcaacaaagtgacacttgctgatgctggcttcatcaaacaatatggtgattgccttggtgatattgctgctagagatctcatctgtgcacaaaagttcaatggactcacggttctaccgcctttgctcacagatgaaatgattgctcaatacacttctgcactacttgctggaacaatcacctcaggttggacctttggtgcaggagctgctttacaaataccctttgcaatgcaaatggcttacaggtttaatggcattggagtcactcagaatgttctatatgagaatcagaaattaattgccaatcagttcaacagtgctattggcaaaatacaggattcactttcatctacggctagtgcacttggtaaacttcaagacgtcgtaaatcaaaatgcacaggctttaaacacacttgtcaaacaacttagttccaattttggagctatttcgagtgtgcttaatgatattctttcacgtcttgacaaagttgaggctgaagtgcaaattgataggttaatcacaggaagactacagagtcttcaaacttatgtgacacaacaattaatcagagcagcagaaatcagagcttctgctaatcttgctgcaacaaaaatgtctgagtgcgtactcggacaatctaaaagagttgatttttgtggaaaaggctaccatttaatgtctttccctcaatcagcaccgcatggtgttgttttcttgcatgttacttatgtacctgcacaagaaaagaactttactactgctcctgctatttgtcatgaaggaaaagcacacttccctcgtgaaggtgtcttcgtttcaaatggcactcattggtttattacacaaaggaatttttatgaacctcaaattattaccactgacaacacattcgtctctggtagctgtgatgttgtaattggaatagtcaacaacacagtttatgatcctttgcaacccgagcttgactcatttaaggaggagttagacaaatacttcaaaaatcacacatcaccagatgttgatcttggcgacatatctggcataaatgcttcggtcgtcaacatacaaaaagaaattgaccgcctcaatgaggttgccaaaaatttgaatgaatcactcattgacctacaagagcttggaaaatatgagcaatacatcaaatggccttggtacatttggcttggttttatagctgggctaattgctatcattatggtcacaatcatgctatgttgtatgactagttgctgtagttgcctcaagggttgttgctcttgcggttcctgctgcaaatttgatgaagacgattcagaacctgttctgaaaggagtcaaattacattacacataaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12270 - RNA, 4070 nt, synthetic construct
  misc_feature 1..4070: note = SARS-CoV-2/pangolin/Guangxi/P1E/2017__EPI_ISL_410539 spike protein mRNA wt (1-1265)
  source 1..4070: mol_type = other RNA
aggagagtcccgcagtcggcgtccagcggctctgcttgttcgtgtgtgtgtcgttgcaggccttattcaagcttaccatgtttgtttttctttttgtcttgcctttggtttccagtcaatgtgtcaatttgaccacaagaactggaatacagccaggttataccaattcatctactagaggtgtctattatccagacaaagtttttaggtcttcaattttacatcttacacaagaccttttcttacctttcttttctaatgttacttggtttaacaccataaattatcaaggaggctttaagaagtttgacaatcctgttttaccatttaatgatggtgtttactttgcctccacggaaaagtccaatattatacgcggttggatttttggaacaacacttgatgccagaactcaatctcttctaatagttaacaacgcaaccaatgttgttatcaaagtatgtgagtttcagttttgcactgatccatttttaggtgtttactatcataacaacaataaaacatgggttgaaaatgagtttagagtttattcaagtgccaacaattgcactttcgaatacatttctcaaccttttcttatggaccttgaaggaaagcaaggtaattttaagaaccttagagagtttgtgtttaaaaatgttgatggttatttcaagatttactctaaacacacacctattgatttagtgcgcgacctccccagaggttttgctgcattggaaccactggtggacctccctataggtattaatattaccagattccaaacattgcttgctttacatagaagttatcttacacctggtaagctagaaagtggctggacaactggagctgctgcttactatgtaggttacctacaacagaggacttttctcttaagttacaatcaaaatggaaccattacagatgctgttgattgttcactagaccctctttcagagacaaagtgcacattaaaatccctaacagttgaaaaaggaatttaccagacttctaacttcagagttcaaccaacaatcagtatagttagatttcctaatattacaaacttatgtccatttggagaagtgtttaacgcatccaaatttgcatcagtttatgcttggaacaggaagagaattagcaattgtgttgctgattactctgtactttataactctacatcattttccacttttaaatgttatggagtttcacctacaaaactcaatgacctttgcttcaccaatgtgtatgcagactcatttgttgttaaaggtgacgaggttagacaaatagcacccggacaaactggtgttattgctgattataactataagctgccagatgattttactggttgtgttattgcttggaactcagttaagcaagatgctttgactggtggtaattatttgtatagattatttagaaagtctaagcttaaaccatttgagagagatatttccactgaaatataccaagccggcagcacaccctgtaacggtcaagttggtctaaattgttattatcctcttgaaaggtatggttttcacccaactacaggtgttaactaccaaccttttagagtggttgttttatcatttgagttacttaatggaccagctactgtttgtggacccaaattgtctacaacactagttaaagacaaatgtgtcaatttcaactttaacggtttaactggcacaggtgttcttacaacatctaagaaacagtttctgccttttcaacaatttggtagagacatctctgacactactgatgctgtccgtgacccacagacacttgaaatacttgacattaccccttgctcttttggaggagttagtgtgataacaccaggtacaaacacttctaatcaagtggctgtactttaccaagatgttaactgtactgaagtgcctatggccattcatgcagaacaacttacacctgcctggcgtgtttactctgcaggagcaaatgtgtttcaaacaagagcaggctgtttagtaggtgctgagcatgtcaacaattcttatgaatgtgacattccagtcggtgctggcatatgtgcaagttaccattccatgtcatcattgcgtagtgtcaaccagcgttcaatcattgcttacactatgtctttaggtgcagaaaattcagttgcttattctaataattcaattgccatacctactaattttacaataagtgttaccacagaaattctaccagtgtcaatgactaagacttctgtagattgtactatgtacatctgtggagattcaattgagtgtagtaatttattgctacaatatggcagtttttgcacacaattaaaccgtgctttgactgggattgctgttgaacaagacaaaaacacacaagaagtttttgcccaggttaaacaaatctacaaaacaccacctattaaagattttggtggctttaacttttcacaaatattgccagatccatcaaaaccaagcaagaggtcatttattgaggatttactcttcaacaaagtgacacttgctgatgctggcttcatcaaacaatatggtgattgccttggtgatattgctgctagagatctcatctgtgcacaaaagttcaatggactcacggttctaccgcctttgctcacagatgaaatgattgctcaatacacttctgcactacttgctggaacaatcacctcaggttggacctttggtgcaggagctgctttacaaataccctttgcaatgcaaatggcttacaggtttaatggcattggagtcactcagaatgttctatatgagaatcagaaattaattgccaatcagttcaacagtgctattggcaaaatacaggattcactttcatctacggctagtgcacttggtaaacttcaagacgtcgtaaatcaaaatgcacaggctttaaacacacttgtcaaacaacttagttccaattttggagctatttcgagtgtgcttaatgatattctttcacgtcttgacaaagttgaggctgaagtgcaaattgataggttaatcacaggaagactacagagtcttcaaacttatgtgacacaacaattaatcagagcagcagaaatcagagcttctgctaatcttgctgcaacaaaaatgtctgagtgcgtactcggacaatctaaaagagttgatttttgtggaaaaggctaccatttaatgtctttccctcaatcagcaccgcatggtgttgttttcttgcatgttacttatgtacctgcacaagaaaagaactttactactgctcctgctatttgtcatgaaggaaaagcacacttccctcgtgaaggtgtcttcgtttcaaatggcactcattggtttattacacaaaggaatttttatgaacctcaaattattaccactgacaacacattcgtctctggtagctgtgatgttgtaattggaatagtcaacaacacagtttatgatcctttgcaacccgagcttgactcatttaaggaggagttagacaaatacttcaaaaatcacacatcaccagatgttgatcttggcgacatatctggcataaatgcttcggtcgtcaacatacaaaaagaaattgaccgcctcaatgaggttgccaaaaatttgaatgaatcactcattgacctacaagagcttggaaaatatgagcaatacatcaaatggccttggtacatttggcttggttttatagctgggctaattgctatcattatggtcacaatcatgctatgttgtatgactagttgctgtagttgcctcaagggttgttgctcttgcggttcctgctgcaaatttgatgaagacgattcagaacctgttctgaaaggagtcaaattacattacacataaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12271 - RNA, 4094 nt, synthetic construct; identical to SEQ ID NO: 148
  misc_feature 1..4094: note = SARS-CoV-2/Wuhan/WIV05/2019__EPI_ISL_402128 spike protein mRNA gc (1-1273) R9488, R9492, R10161
  source 1..4094: mol_type = other RNA

SEQ ID NO: 12272 - RNA, 4082 nt, synthetic construct
  misc_feature 1..4082: note = SARS-CoV-2/bat/Yunnan/RaTG13/2013__EPI_ISL_402131 spike protein mRNA gc (1-1269)
  source 1..4082: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagctccacccggggcgtctactaccccgacaaggtgttccgcagctccgtgctgcacctcacccaggacctgttcctgcccttcttcagcaacgtcacgtggttccacgccatccacgtgtccgggaccaacggcatcaagcggttcgacaacccggtgctccccttcaacgacggggtctacttcgcgagcaccgagaagtccaacatcatccgcggctggatcttcgggaccacgctggacagcaagacccagtccctgctcatcgtgaacaacgccaccaacgtggtcatcaaggtgtgcgagttccagttctgcaacgaccccttcctgggcgtgtactaccacaagaacaacaagagctggatggagtccgagttccgggtctacagctccgccaacaactgcaccttcgagtacgtgagccagcccttcctgatggacctcgagggcaagcaggggaacttcaagaacctgcgcgagttcgtgttcaagaacatcgacggctacttcaagatctactccaagcacacgccgatcaacctggtccgggacctcccgcccgggttcagcgccctggagcccctggtggacctccccatcggcatcaacatcacccgcttccagaccctgctggccctccaccggtcctacctgacccccggggacagcagctccggctggacggcgggcgccgccgcctactacgtggggtacctgcagccccgcaccttcctcctgaagtacaacgagaacggcaccatcaccgacgcggtcgactgcgccctggaccccctcagcgagacgaagtgcaccctgaagtccttcaccgtggagaaggggatctaccagaccagcaacttccgggtgcagccgacggactccatcgtccgcttccccaacatcaccaacctgtgccccttcggcgaggtgttcaacgccaccaccttcgccagcgtctacgcctggaaccggaagcgcatctccaactgcgtggcggactacagcgtgctctacaactccacgagcttctccaccttcaagtgctacggcgtcagccccaccaagctgaacgacctgtgcttcaccaacgtgtacgccgactccttcgtgatcacgggggacgaggtccggcagatcgccccgggccagaccgggaagatcgccgactacaactacaagctccccgacgacttcaccggctgcgtgatcgcctggaacagcaagcacatcgacgcgaaggagggcgggaacttcaactacctgtaccgcctgttccggaaggccaacctcaagcccttcgagcgcgacatctccaccgagatctaccaggccggcagcaagccctgcaacgggcagacgggcctgaactgctactacccgctgtaccggtacgggttctaccccaccgacggcgtggggcaccagccctaccgcgtcgtggtgctctccttcgagctgctgaacgcccccgccaccgtctgcggcccgaagaagtccaccaacctcgtgaagaacaagtgcgtgaacttcaacttcaacggcctgaccgggacgggcgtcctgaccgagagcaacaagaagttcctgcccttccagcagttcgggcgggacatcgcggacaccaccgacgccgtgcgcgacccccagacgctcgagatcctggacatcaccccgtgcagcttcggcggggtgagcgtcatcacccccggcaccaacgcctccaaccaggtggccgtgctgtaccaggacgtcaactgcacggaggtgcccgtggccatccacgcggaccagctcacccccacctggcgcgtctacagcaccggctccaacgtgttccagacgcgggccgggtgcctgatcggcgccgagcacgtgaacaacagctacgagtgcgacatcccgatcggggccggcatctgcgcgtcctaccagacccagaccaacagccgctccgtcgccagccagtccatcatcgcctacaccatgagcctgggcgccgagaactccgtggcctacagcaacaactccatcgcgatccccacgaacttcaccatcagcgtgaccaccgagatcctccccgtctccatgacgaagaccagcgtggactgcaccatgtacatctgcggggactccaccgagtgcagcaacctgctgctccagtacggcagcttctgcacgcagctgaaccgggccctgaccgggatcgccgtggagcaggacaagaacacccaggaggtcttcgcccaggtgaagcagatctacaagacgcccccgatcaaggacttcggcgggttcaacttctcccagatcctccccgaccccagcaagccctccaagcgcagcttcatcgaggacctgctgttcaacaaggtgaccctcgccgacgcgggcttcatcaagcagtacggcgactgcctgggggacatcgccgcccgggacctgatctgcgcccagaagttcaacggcctcaccgtcctgccgcccctgctcaccgacgagatgatcgcccagtacacctccgcgctgctggccgggacgatcaccagcggctggaccttcggggccggcgccgcgctccagatccccttcgccatgcagatggcctaccgcttcaacggcatcggggtgacccagaacgtgctgtacgagaaccagaagctgatcgccaaccagttcaactccgccatcggcaagatccaggacagcctctccagcacggcgtccgccctggggaagctgcaggacgtcgtgaaccagaacgcccaggccctcaacaccctggtgaagcagctgagctccaacttcggcgccatcagctccgtcctcaacgacatcctgagccggctggacaaggtggaggcggaggtgcagatcgaccgcctcatcaccgggcggctgcagtccctgcagacctacgtcacccagcagctcatccgcgccgccgagatccgggccagcgccaacctggcggccacgaagatgtccgagtgcgtgctgggccagagcaagcgcgtggacttctgcggcaaggggtaccacctcatgagcttcccccagtccgccccgcacggcgtcgtgttcctgcacgtgacctacgtccccgcccaggagaagaacttcaccaccgcgcccgccatctgccacgacgggaaggcccacttcccccgggagggcgtgttcgtcagcaacgggacgcactggttcgtgacccagcgcaacttctacgagccgcagatcatcaccaccgacaacacgttcgtgtccggcagctgcgacgtcgtgatcggcatcgtgaacaacaccgtctacgaccccctgcagcccgagctcgactccttcaaggaggagctggacaagtacttcaagaaccacaccagccccgacgtggacctgggggacatctccggcatcaacgccagcgtggtcaacatccagaaggagatcgaccggctcaacgaggtggccaagaacctgaacgagtccctgatcgacctccaggagctggggaagtacgagcagtacatcaagtggccgtggtacatctggctgggcttcatcgcgggcctcatcgccatcatcatggtgaccatcatgctgtgctgcatgacgagctgctgctcctgcctgaaggggtgctgcagctgcggctcctgctgcaagttcgacgaggacgacagcgagcccgtcctcaagggggtgaagctgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12273 - RNA, 4094 nt, synthetic construct
  misc_feature 1..4094: note = SARS-CoV-2/Wuhan/HBCDC-HB-01/2019__EPI_ISL_402132 spike protein mRNA gc (1-1273)
  source 1..4094: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcatcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12274 - RNA, 4094 nt, synthetic construct
  misc_feature 1..4094: note = SARS-CoV-2/Guangdong/20SF028/2020__EPI_ISL_403936 spike protein mRNA gc (1-1273)
  source 1..4094: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgtactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12275 - RNA, 4094 nt, synthetic construct
  misc_feature 1..4094: note = SARS-CoV-2/Shenzhen/SZTH-001/2020__EPI_ISL_406592 spike protein mRNA gc (1-1273)
  source 1..4094: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtgctgatcggcatcgtcaacaacacggtgtacgaccccctgcagcccgagctcgactccttcaaggaggagctggacaagtacttcaagaaccacaccagccccgacgtggacctgggggacatctccggcatcaacgccagcgtcgtgaacatccagaaggagatcgaccgcctcaacgaggtggccaagaacctgaacgagtccctgatcgacctccaggagctggggaagtacgagcagtacatcaagtggccgtggtacatctggctgggcttcatcgccggcctcatcgcgatcgtcatggtgaccatcatgctgtgctgcatgaccagctgctgctcctgcctgaaggggtgctgcagctgcggctcctgctgcaagttcgacgaggacgacagcgggcccgtgctcaagggcgtcaagctgcactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12276 - RNA, 4094 nt, synthetic construct
  misc_feature 1..4094: note = SARS-CoV-2/Shenzhen/SZTH-004/2020__EPI_ISL_406595 spike protein mRNA gc (1-1273)
  source 1..4094: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctgggaccgcaagcggatctccaactgcgtggcgtactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12277 - RNA, 4094 nt, synthetic construct
  misc_feature 1..4094: note = SARS-CoV-2/France/IDF0372/2020__EPI_ISL_406596 spike protein mRNA gc (1-1273)
  source 1..4094: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcttcctgtacaactccgccagcttctccacgttcaagtgctacggcgtgagccccaccaagctcaacgacctgtgcttcaccaacgtctacgccgactccttcgtgatccgcggggacgaggtgcggcagatcgcccccggccagaccgggaagatcgccgactacaactacaagctgccggacgacttcacgggctgcgtcatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtggtcctgagcttcgagctcctgcacgcccccgccacggtgtgcggccccaagaagtccaccaacctggtgaagaacaagtgcgtcaacttcaacttcaacggcctcaccgggaccggcgtgctgaccgagagcaacaagaagttcctgccgttccagcagttcgggcgcgacatcgccgacacgaccgacgcggtgcgcgacccccagaccctggagatcctcgacatcaccccctgcagcttcggcggggtctccgtgatcacgccgggcaccaacaccagcaaccaggtggccgtcctgtaccaggacgtgaactgcaccgaggtgcccgtcgccatccacgccgaccagctgacgcccacctggcgggtgtactccaccggcagcaacgtgttccagacccgcgccgggtgcctcatcggcgcggagcacgtcaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtggcctactccaacaacagcatcgccatccccaccaacttcacgatctccgtcaccaccgagatcctgcccgtgagcatgaccaagacgagcgtggactgcaccatgtacatctgcggggactccaccgagtgcagcaacctcctgctgcagtacggctccttctgcacccagctcaaccgcgcgctgacggggatcgccgtcgagcaggacaagaacacccaggaggtgttcgcccaggtgaagcagatctacaagacgcccccgatcaaggacttcggcgggttcaacttcagccagatcctgcccgacccctccaagcccagcaagcggtccttcatcgaggacctcctgttcaacaaggtcaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtgacccagaacgtcctctacgagaaccagaagctgatcgccaaccagttcaacagcgccatcggcaagatccaggactccctgagctccaccgccagcgcgctcgggaagctgcaggacgtggtgaaccagaacgcccaggccctgaacacgctcgtcaagcagctgtccagcaacttcggcgccatctccagcgtgctgaacgacatcctctcccgcctggacaaggtggaggccgaggtccagatcgaccggctgatcaccgggcgcctccagagcctgcagacctacgtgacccagcagctgatccgggcggccgagatccgcgccagcgccaacctcgccgcgaccaagatgtccgagtgcgtgctgggccagagcaagcgggtcgacttctgcggcaaggggtaccacctgatgtccttcccccagagcgccccgcacggcgtggtgttcctccacgtcacgtacgtgcccgcccaggagaagaacttcaccaccgcccccgcgatctgccacgacgggaaggcccacttcccccgcgagggcgtcttcgtgtccaacgggacccactggttcgtgacgcagcggaacttctacgagccgcagatcatcaccaccgacaacaccttcgtcagcggcaactgcgacgtggtgatcggcatcgtcaacaacacggtgtacgaccccctgcagcccgagctggactccttcaaggaggagctcgacaagtacttcaagaaccacaccagccccgacgtggacctgggggacatctccggcatcaacgccagcgtcgtgaacatccagaaggagatcgaccgcctgaacgaggtggccaagaacctcaacgagtccctgatcgacctgcaggagctcgggaagtacgagcagtacatcaagtggccgtggtacatctggctgggcttcatcgccggcctgatcgcgatcgtcatggtgaccatcatgctctgctgcatgaccagctgctgctcctgcctgaaggggtgctgcagctgcggctcctgctgcaagttcgacgaggacgacagcgagcccgtgctgaagggggtcaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12278 - RNA, 4094 nt, synthetic construct
  misc_feature 1..4094: note = SARS-CoV-2/Australia/VIC01/2020__EPI_ISL_406844 spike protein mRNA gc (1-1273)
  source 1..4094: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggcgctacctcacgccgggggactccagcagcggctggaccgcgggcgccgccgcctactacgtggggtacctgcagccccggaccttcctgctcaagtacaacgagaacggcaccatcacggacgcggtcgactgcgccctggaccccctgtccgagaccaagtgcaccctcaagagcttcaccgtggagaaggggatctaccagacgtccaacttccgcgtgcagcccaccgagagcatcgtccggttcccgaacatcaccaacctgtgccccttcggcgaggtgttcaacgccacccgcttcgcctccgtctacgcctggaaccggaagcgcatcagcaactgcgtggcggactactccgtgctgtacaacagcgcctccttcagcacgttcaagtgctacggcgtctcccccaccaagctcaacgacctgtgcttcaccaacgtgtacgccgacagcttcgtgatccgcggggacgaggtccggcagatcgcccccggccagaccgggaagatcgccgactacaactacaagctgccggacgacttcacgggctgcgtgatcgcgtggaactccaacaacctcgacagcaaggtcgggggcaactacaactacctgtaccggctgttccgcaagtccaacctcaagcccttcgagcgggacatcagcaccgagatctaccaggccggctccaccccctgcaacggggtggagggcttcaactgctacttccccctgcagagctacgggttccagccgaccaacggcgtggggtaccagccctaccgcgtggtcgtgctgtccttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgggacccccagaccctggagatcctcgacatcaccccctgcagcttcggcggggtgagcgtgatcacgccgggcaccaacacctccaaccaggtcgccgtgctgtaccaggacgtgaactgcaccgaggtccccgtggccatccacgccgaccagctgacgcccacctggcgcgtgtacagcaccggctccaacgtcttccagacccgggccgggtgcctcatcggcgcggagcacgtgaacaacagctacgagtgcgacatccccatcggggccggcatctgcgcctcctaccagacgcagaccaacagcccgcgccgggcccgctccgtggcgagccagtccatcatcgcctacaccatgagcctgggcgccgagaactccgtcgcctacagcaacaactccatcgccatccccaccaacttcacgatcagcgtgaccaccgagatcctgcccgtgtccatgaccaagacgagcgtcgactgcaccatgtacatctgcggggacagcaccgagtgctccaacctcctgctgcagtacggcagcttctgcacccagctcaaccgggcgctgacggggatcgccgtggagcaggacaagaacacccaggaggtgttcgcccaggtcaagcagatctacaagacgcccccgatcaaggacttcggcgggttcaacttctcccagatcctgcccgaccccagcaagccctccaagcgcagcttcatcgaggacctcctgttcaacaaggtgaccctggccgacgccggcttcatcaagcagtacggcgactgcctcggggacatcgcggcccgggacctgatctgcgcccagaagttcaacggcctgaccgtgctcccgcccctgctgaccgacgagatgatcgcccagtacacctccgccctcctggcggggaccatcacgagcggctggaccttcggggccggcgccgccctgcagatccccttcgcgatgcagatggcctaccgcttcaacggcatcggggtcacccagaacgtgctctacgagaaccagaagctgatcgccaaccagttcaactccgccatcggcaagatccaggacagcctgtccagcaccgcctccgcgctcgggaagctgcaggacgtggtcaaccagaacgcccaggccctgaacacgctcgtgaagcagctgagctccaacttcggcgccatcagctccgtgctgaacgacatcctcagccggctggacaaggtcgaggccgaggtgcagatcgaccgcctgatcaccgggcggctccagtccctgcagacctacgtgacccagcagctgatccgcgcggccgagatccgggccagcgccaacctcgccgcgaccaagatgagcgagtgcgtcctgggccagtccaagcgcgtggacttctgcggcaaggggtaccacctgatgagcttcccccagtccgccccgcacggcgtggtcttcctccacgtgacgtacgtccccgcccaggagaagaacttcaccaccgcccccgcgatctgccacgacgggaaggcccacttcccccgggagggcgtgttcgtgagcaacgggacccactggttcgtcacgcagcgcaacttctacgagccgcagatcatcaccaccgacaacaccttcgtgtccggcaactgcgacgtggtcatcggcatcgtgaacaacacggtgtacgaccccctgcagcccgagctggacagcttcaaggaggagctcgacaagtacttcaagaaccacacctcccccgacgtcgacctgggggacatcagcggcatcaacgcctccgtggtgaacatccagaaggagatcgaccggctgaacgaggtcgccaagaacctcaacgagagcctgatcgacctgcaggagctcgggaagtacgagcagtacatcaagtggccgtggtacatctggctgggcttcatcgccggcctgatcgcgatcgtgatggtgaccatcatgctctgctgcatgacctcctgctgcagctgcctgaaggggtgctgctcctgcggcagctgctgcaagttcgacgaggacgactccgagcccgtcctgaagggggtgaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12279 - RNA, 4094 nt, synthetic construct
  misc_feature 1..4094: note = SARS-CoV-2/Germany/BavPat1/2020__EPI_ISL_406862 spike protein mRNA gc (1-1273)
  source 1..4094: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacaaggtcgaggccgaggtgcagatcgaccggctgatcaccggccgcctccagagcctgcagacctacgtgacccagcagctgatccgggcggccgagatccgcgccagcgccaacctcgccgcgaccaagatgtccgagtgcgtcctgggccagagcaagcgggtggacttctgcgggaagggctaccacctgatgtccttcccccagagcgccccgcacggggtggtcttcctccacgtgacgtacgtccccgcccaggagaagaacttcaccaccgcccccgcgatctgccacgacggcaaggcccacttcccccgcgagggggtgttcgtgtccaacggcacccactggttcgtcacgcagcggaacttctacgagccgcagatcatcaccaccgacaacaccttcgtgagcggcaactgcgacgtggtcatcgggatcgtgaacaacacggtgtacgaccccctgcagcccgagctggactccttcaaggaggagctcgacaagtacttcaagaaccacaccagccccgacgtcgacctgggcgacatctccgggatcaacgccagcgtggtgaacatccagaaggagatcgaccgcctgaacgaggtcgccaagaacctcaacgagtccctgatcgacctgcaggagctcggcaagtacgagcagtacatcaagtggccgtggtacatctggctgggcttcatcgccgggctgatcgcgatcgtgatggtgaccatcatgctctgctgcatgaccagctgctgctcctgcctgaagggctgctgcagctgcgggtcctgctgcaagttcgacgaggacgacagcgagcccgtcctgaagggcgtgaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12280 - RNA, 4094 nt, synthetic construct
  misc_feature 1..4094: note = SARS-CoV-2/Wuhan/HBCDC-HB-02/2020__EPI_ISL_412978 spike protein mRNA gc (1-1273)
  source 1..4094: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacttcctcctgcagtacggctccttctgcacccagctgaaccgcgcgctcacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctgggggacatcgcggcccgcgacctcatctgcgcccagaagttcaacggcctgaccgtgctgccgcccctcctgaccgacgagatgatcgcccagtacaccagcgccctgctcgcggggaccatcacgtccggctggaccttcggggccggcgccgccctgcagatccccttcgcgatgcagatggcctaccggttcaacggcatcggggtcacccagaacgtgctgtacgagaaccagaagctcatcgccaaccagttcaacagcgccatcggcaagatccaggactccctgagctccaccgccagcgcgctggggaagctccaggacgtggtcaaccagaacgcccaggccctgaacacgctggtgaagcagctctccagcaacttcggcgccatctccagcgtgctgaacgacatcctgtcccgcctcgacaaggtcgaggccgaggtgcagatcgaccggctgatcaccgggcgcctgcagagcctccagacctacgtgacccagcagctgatccgggcggccgagatccgcgccagcgccaacctggccgcgaccaagatgtccgagtgcgtcctcggccagagcaagcgggtggacttctgcggcaaggggtaccacctgatgtccttcccccagagcgccccgcacggcgtggtcttcctgcacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctccagcccgagctggactccttcaaggaggagctggacaagtacttcaagaaccacaccagccccgacgtcgacctcggggacatctccggcatcaacgccagcgtggtgaacatccagaaggagatcgaccgcctgaacgaggtcgccaagaacctgaacgagtccctcatcgacctgcaggagctggggaagtacgagcagtacatcaagtggccgtggtacatctggctcggcttcatcgccggcctgatcgcgatcgtgatggtgaccatcatgctgtgctgcatgaccagctgctgctcctgcctcaaggggtgctgcagctgcggctcctgctgcaagttcgacgaggacgacagcgagcccgtcctgaagggggtgaagctgcactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12281 - RNA, 4094 nt, synthetic construct
  misc_feature 1..4094: note = SARS-CoV-2/Australia/QLD02/2020__EPI_ISL_407896 spike protein mRNA gc (1-1273)
  source 1..4094: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagctggagctcgactccttcaaggaggagctggacaagtacttcaagaaccacaccagccccgacgtcgacctgggggacatctccggcatcaacgccagcgtggtgaacatccagaaggagatcgaccgcctcaacgaggtcgccaagaacctgaacgagtccctgatcgacctccaggagctggggaagtacgagcagtacatcaagtggccctggtacatctggctgggcttcatcgccggcctcatcgcgatcgtgatggtgaccatcatgctgtgctgcatgaccagctgctgctcctgcctgaaggggtgctgcagctgcggctcctgctgcaagttcgacgaggacgacagcgagccggtcctcaagggggtgaagctgcactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12282 - RNA, 4094 nt, synthetic construct
  misc_feature 1..4094: note = SARS-CoV-2/India/1-31/2020__EPI_ISL_413523 spike protein mRNA gc (1-1273)
  source 1..4094: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgtgatcggcaagatccaggactccctgagctccaccgccagcgccctcgggaagctgcaggacgtcgtgaaccagaacgcgcaggccctgaacacgctcgtgaagcagctgtccagcaacttcggcgccatctccagcgtcctgaacgacatcctctcccgcctggacaaggtggaggccgaggtgcagatcgaccggctgatcaccgggcgcctccagagcctgcagacctacgtcacccagcagctgatccgggccgcggagatccgcgccagcgccaacctcgccgccaccaagatgtccgagtgcgtgctgggccagagcaagcgggtggacttctgcggcaaggggtaccacctgatgtccttcccccagagcgcgccgcacggcgtcgtgttcctccacgtcacgtacgtgcccgcccaggagaagaacttcaccaccgcccccgccatctgccacgacgggaaggcgcacttcccccgcgagggcgtgttcgtctccaacgggacccactggttcgtgacgcagcggaacttctacgagccgcagatcatcaccaccgacaacaccttcgtgagcggcaactgcgacgtcgtgatcggcatcgtgaacaacacggtctacgaccccctgcagcccgagctggactccttcaaggaggagctcgacaagtacttcaagaaccacaccagccccgacgtggacctgggggacatctccggcatcaacgccagcgtggtcaacatccagaaggagatcgaccgcctgaacgaggtggccaagaacctcaacgagtccctgatcgacctgcaggagctcgggaagtacgagcagtacatcaagtggccgtggtacatctggctgggcttcatcgccggcctgatcgccatcgtgatggtcaccatcatgctctgctgcatgaccagctgctgctcctgcctgaaggggtgctgcagctgcggctcctgctgcaagttcgacgaggacgacagcgagcccgtgctgaagggggtgaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12283 - RNA, 4094 nt, synthetic construct
  misc_feature 1..4094: note SARS-CoV-2/Guangdong/GD2020087-P0008/2020__EPI_ISL_413863 spike protein mRNA gc (1-1273)
  source 1..4094: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccgggagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12284 - RNA, 4094 nt, synthetic construct
  misc_feature 1..4094: note = SARS-CoV-2/Sweden/01/2020__EPI_ISL_411951 spike protein mRNA gc (1-1273)
  source 1..4094: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggactgcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12285 - RNA, 4094 nt, synthetic construct
  misc_feature 1..4094: note = SARS-CoV-2/Tianmen/HBCDC-HB-07/2020__EPI_ISL_412983 spike protein mRNA gc (1-1273)
  source 1..4094: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacctgaactgcaccgaggtgcccgtcgccatccacgccgaccagctcacgcccacctggcgggtgtactccaccggcagcaacgtgttccagacccgcgccgggtgcctgatcggcgcggagcacgtcaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtggcctactccaacaacagcatcgccatccccaccaacttcacgatctccgtcaccaccgagatcctccccgtgagcatgaccaagacgagcgtggactgcaccatgtacatctgcggggactccaccgagtgcagcaacctgctgctccagtacggctccttctgcacccagctgaaccgcgcgctgacggggatcgccgtcgagcaggacaagaacacccaggaggtgttcgcccaggtgaagcagatctacaagacgcccccgatcaaggacttcggcgggttcaacttcagccagatcctccccgacccctccaagcccagcaagcggtccttcatcgaggacctgctgttcaacaaggtcaccctcgccgacgccggcttcatcaagcagtacggcgactgcctgggggacatcgcggcccgcgacctgatctgcgcccagaagttcaacggcctcaccgtgctgccgcccctgctcaccgacgagatgatcgcccagtacaccagcgccctgctggcggggaccatcacgtccggctggaccttcggggccggcgccgccctccagatccccttcgcgatgcagatggcctaccggttcaacggcatcggggtgacccagaacgtcctgtacgagaaccagaagctgatcgccaaccagttcaacagcgccatcggcaagatccaggactccctcagctccaccgccagcgcgctggggaagctgcaggacgtggtgaaccagaacgcccaggccctcaacacgctggtcaagcagctgtccagcaacttcggcgccatctccagcgtgctcaacgacatcctgtcccgcctggacaaggtggaggccgaggtccagatcgaccggctcatcaccgggcgcctgcagagcctgcagacctacgtgacccagcagctcatccgggcggccgagatccgcgccagcgccaacctggccgcgaccaagatgtccgagtgcgtgctgggccagagcaagcgggtcgacttctgcggcaaggggtaccacctcatgtccttcccccagagcgccccgcacggcgtggtgttcctgcacgtcacgtacgtgcccgcccaggagaagaacttcaccaccgcccccgcgatctgccacgacgggaaggcccacttcccccgcgagggcgtcttcgtgtccaacgggacccactggttcgtgacgcagcggaacttctacgagccgcagatcatcaccaccgacaacaccttcgtcagcggcaactgcgacgtggtgatcggcatcgtcaacaacacggtgtacgaccccctgcagcccgagctcgactccttcaaggaggagctggacaagtacttcaagaaccacaccagccccgacgtggacctgggggacatctccggcatcaacgccagcgtcgtgaacatccagaaggagatcgaccgcctcaacgaggtggccaagaacctgaacgagtccctgatcgacctccaggagctggggaagtacgagcagtacatcaagtggccgtggtacatctggctgggcttcatcgccggcctcatcgcgatcgtcatggtgaccatcatgctgtgctgcatgaccagctgctgctcctgcctgaaggggtgctgcagctgcggctcctgctgcaagttcgacgaggacgacagcgagcccgtgctcaagggggtcaagctgcactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12286 - RNA, 4094 nt, synthetic construct
  misc_feature 1..4094: note = SARS-CoV-2/Hong Kong/case42_VM20002493/2020__EPI_ISL_414527 spike protein mRNA gc (1-1273)
  source 1..4094: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcgcgatctccgtgacgaccgagatcctgcccgtgagcatgaccaagaccagcgtcgactgcacgatgtacatctgcggggactccaccgagtgcagcaacctcctgctgcagtacggctccttctgcacccagctcaaccgcgccctgaccgggatcgccgtggagcaggacaagaacacgcaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgcgggcttcatcaagcagtacggcgactgcctcggggacatcgccgcccgcgacctgatctgcgcccagaagttcaacggcctgaccgtgctcccgcccctgctgaccgacgagatgatcgcccagtacaccagcgcgctcctggccgggaccatcacctccggctggacgttcggggccggcgccgcgctgcagatccccttcgccatgcagatggcctaccggttcaacggcatcggggtcacccagaacgtgctctacgagaaccagaagctgatcgccaaccagttcaacagcgccatcggcaagatccaggactccctgagctccaccgcgagcgccctcgggaagctgcaggacgtggtcaaccagaacgcccaggccctgaacaccctcgtgaagcagctgtccagcaacttcggcgccatctccagcgtgctgaacgacatcctctcccgcctggacaaggtcgaggcggaggtgcagatcgaccggctgatcacggggcgcctccagagcctgcagacctacgtgacccagcagctgatccgggccgccgagatccgcgccagcgccaacctcgcggccaccaagatgtccgagtgcgtcctgggccagagcaagcgggtggacttctgcggcaaggggtaccacctgatgtccttcccccagagcgccccgcacggcgtggtcttcctccacgtgacctacgtccccgcccaggagaagaacttcacgaccgcgcccgccatctgccacgacgggaaggcccacttcccccgcgagggcgtgttcgtgtccaacgggacccactggttcgtcacccagcggaacttctacgagccgcagatcatcacgaccgacaacaccttcgtgagcggcaactgcgacgtggtcatcggcatcgtgaacaacaccgtgtacgaccccctgcagcccgagctggactccttcaaggaggagctcgacaagtacttcaagaaccacacgagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgcgggcctgatcgccatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12287 - RNA, 4094 nt, synthetic construct
  misc_feature 1..4094: note = SARS-CoV-2/USA/CruiseA-23/2020__EPI_ISL_414482 spike protein mRNA gc (1-1273)
  source 1..4094: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggaggtgaagcagggcaacttcaagaacctccgcgagttcgtcttcaagaacatcgacgggtacttcaagatctactccaagcacaccccgatcaacctggtgcgggacctgccccagggcttcagcgccctcgagcccctggtggacctgcccatcgggatcaacatcacccgcttccagaccctcctggccctgcaccggtcctacctcacgccgggcgacagcagctccgggtggaccgcgggcgccgccgcctactacgtcggctacctgcagccccgcaccttcctgctcaagtacaacgagaacgggaccatcacggacgcggtggactgcgccctggaccccctgagcgagaccaagtgcaccctcaagtccttcaccgtggagaagggcatctaccagacgagcaacttccgggtccagcccaccgagtccatcgtgcgcttcccgaacatcaccaacctgtgccccttcggggaggtcttcaacgccacccggttcgccagcgtgtacgcctggaaccgcaagcggatctccaactgcgtggcggactacagcgtcctgtacaactccgccagcttctccacgttcaagtgctacggcgtgagccccaccaagctcaacgacctgtgcttcaccaacgtgtacgccgactccttcgtcatccgcggcgacgaggtgcggcagatcgcccccgggcagaccggcaagatcgccgactacaactacaagctgccggacgacttcacggggtgcgtgatcgcgtggaacagcaacaacctcgactccaaggtcggcgggaactacaactacctgtaccgcctgttccgcaagagcaacctcaagcccttcgagcgggacatctccaccgagatctaccaggccggcagcaccccctgcaacggcgtggaggggttcaactgctacttccccctgcagtcctacggcttccagccgaccaacggggtgggctaccagccctaccgggtcgtggtgctgagcttcgagctcctgcacgcccccgccacggtctgcgggcccaagaagtccaccaacctggtgaagaacaagtgcgtgaacttcaacttcaacggcctcaccggcaccggggtcctgaccgagagcaacaagaagttcctgccgttccagcagttcggccgcgacatcgccgacacgaccgacgcggtgcgcgacccccagaccctggagatcctcgacatcaccccctgcagcttcgggggcgtgtccgtcatcacgccggggaccaacaccagcaaccaggtggccgtgctgtaccaggacgtcaactgcaccgaggtgcccgtggccatccacgccgaccagctgacgcccacctggcgggtctactccaccggcagcaacgtgttccagacccgcgccggctgcctcatcggggcggagcacgtgaacaactcctacgagtgcgacatccccatcggcgccgggatctgcgccagctaccagacgcagaccaactccccgcggcgcgcccggagcgtcgcgtcccagagcatcatcgcctacaccatgtccctgggcgccgagaacagcgtggcctactccaacaacagcatcgccatccccaccaacttcacgatctccgtgaccaccgagatcctgcccgtcagcatgaccaagacgagcgtggactgcaccatgtacatctgcggcgactccaccgagtgcagcaacctcctgctgcagtacgggtccttctgcacccagctcaaccgcgcgctgacgggcatcgccgtggagcaggacaagaacacccaggaggtcttcgcccaggtgaagcagatctacaagacgcccccgatcaaggacttcgggggcttcaacttcagccagatcctgcccgacccctccaagcccagcaagcggtccttcatcgaggacctcctgttcaacaaggtgaccctggccgacgccgggttcatcaagcagtacggcgactgcctcggcgacatcgcggcccgcgacctgatctgcgcccagaagttcaacgggctgaccgtcctcccgcccctgctgaccgacgagatgatcgcccagtacaccagcgccctcctggcgggcaccatcacgtccgggtggaccttcggcgccggggccgccctgcagatccccttcgcgatgcagatggcctaccggttcaacggcatcggcgtgacccagaacgtgctctacgagaaccagaagctgatcgccaaccagttcaacagcgccatcgggaagatccaggactccctgagctccaccgccagcgcgctcggcaagctgcaggacgtcgtgaaccagaacgcccaggccctgaacacgctcgtgaagcagctgtccagcaacttcggggccatctccagcgtcctgaacgacatcctctcccgcctggacaaggtggaggccgaggtgcagatcgaccggctgatcaccggccgcctccagagcctgcagacctacgtcacccagcagctgatccgggcggccgagatccgcgccagcgccaacctcgccgcgaccaagatgtccgagtgcgtgctggggcagagcaagcgggtggacttctgcggcaagggctaccacctgatgtccttcccccagagcgccccgcacggggtcgtgttcctccacgtcacgtacgtgcccgcccaggagaagaacttcaccaccgcccccgcgatctgccacgacggcaaggcccacttcccccgcgagggggtgttcgtctccaacggcacccactggttcgtgacgcagcggaacttctacgagccgcagatcatcaccaccgacaacaccttcgtgagcgggaactgcgacgtcgtgatcggcatcgtgaacaacacggtctacgaccccctgcagcccgagctggactccttcaaggaggagctcgacaagtacttcaagaaccacaccagccccgacgtggacctgggcgacatctccgggatcaacgccagcgtggtcaacatccagaaggagatcgaccgcctgaacgaggtggccaagaacctcaacgagtccctgatcgacctgcaggagctcggcaagtacgagcagtacatcaagtggccgtggtacatctggctggggttcatcgccggcctgatcgcgatcgtgatggtcaccatcatgctctgctgcatgaccagctgctgctcctgcctgaagggctgctgcagctgcgggtcctgctgcaagttcgacgaggacgacagcgagcccgtgctgaagggcgtgaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12288 - RNA, 4094 nt, synthetic construct
  misc_feature 1..4094: note = SARS-CoV-2/Hong Kong/case85_VM20002868/2020__EPI_ISL_414519 spike protein mRNA gc (1-1273)
  source 1..4094: mol_type = other RNA
aggagagtcccgcagtcggcgtccagcggctctgcttgttcgtgtgtgtgtcgttgcaggccttattcaagcttaccatgttcgtgttcctggtcctcgtgcccctggtgagctcccagtgcgtcaacctgaccacccgcacgcagctcccgcccgcctacaccaacagcttcacccggggcgtgtactaccccgacaaggtgttccgctccagcgtcctgcactccacccaggacctgttcctccccttcttcagcaacgtgacgtggttccacgccatccacgtgtccgggaccaacggcaccaagcggttcgacaacccggtcctgcccttcaacgacggggtgtacttcgcgagcaccgagaagtccaacatcatccgcggctggatcttcgggacgaccctggacagcaagacccagtccctcctgatcgtgaacaacgccaccaacgtcgtgatcaaggtgtgcgagttccagttctgcaacgaccccttcctgggcgtctactaccacaagaacaacaagagctggatggagtccgagttccgggtgtacagctccgccaacaactgcacgttcgagtacgtgagccagcccttcctcatggacctggagggcaagcaggggaacttcaagaacctgcgcgagttcgtcttcaagaacatcgacggctacttcaagatctactccaagcacaccccgatcaacctcgtgcgggacctgccccaggggttcagcgccctggagcccctcgtggacctgcccatcggcatcaacatcacccgcttccagaccctgctcgccctgcaccggtcctacctgacgccgggggacagcagctccggctggaccgcgggcgccgccgcctactacgtcgggtacctccagccccgcaccttcctgctgaagtacaacgagaacggcaccatcacggacgcggtggactgcgccctcgaccccctgagcgagaccaagtgcaccctgaagtccttcaccgtggagaaggggatctaccagacgagcaacttccgggtccagcccaccgagtccatcgtgcgcttcccgaacatcaccaacctctgccccttcggcgaggtcttcaacgccacccggttcgccagcgtgtacgcctggaaccgcaagcggatctccaactgcgtggcggactacagcgtcctgtacaactccgccagcttctccacgttcaagtgctacggcgtgagccccaccaagctgaacgacctctgcttcaccaacgtgtacgccgactccttcgtcatccgcggggacgaggtgcggcagatcgcccccggccagaccgggaagatcgccgactacaactacaagctgccggacgacttcacgggctgcgtgatcgcgtggaacagcaacaacctggactccaaggtcgggggcaactacaactacctctaccgcctgttccgcaagagcaacctgaagcccttcgagcgggacatctccaccgagatctaccaggccggcagcaccccctgcaacggggtggagggcttcaactgctacttccccctccagtcctacgggttccagccgaccaacggcgtggggtaccagccctaccgggtcgtggtgctgagcttcgagctgctccacgcccccgccacggtctgcggccccaagaagtccaccaacctggtgaagaacaagtgcgtgaacttcaacttcaacggcctgaccgggaccggcgtcctcaccgagagcaacaagaagttcctgccgttccagcagttcgggcgcgacatcgccgacacgaccgacgcggtgcgcgacccccagaccctggagatcctggacatcaccccctgcagcttcggcggggtgtccgtcatcacgccgggcaccaacaccagcaaccaggtggccgtgctctaccaggacgtcaactgcaccgaggtgcccgtggccatccacgccgaccagctgacgcccacctggcgggtctactccaccggcagcaacgtgttccagacccgcgccgggtgcctgatcggcgcggagcacgtgaacaactcctacgagtgcgacatccccatcggggccggcatctgcgccagctaccagacgcagaccaactccccgcggcgcgcccggagcgtcgcgtcccagagcatcatcgcctacaccatgtccctcggcgccgagaacagcgtggcctactccaacaacagcatcgccatccccaccaacttcacgatctccgtgaccaccgagatcctgcccgtcagcatgaccaagacgagcgtggactgcaccatgtacatctgcggggactccaccgagtgcagcaacctgctcctgcagtacggctccttctgcacccagctgaaccgcgcgctcacggggatcgccgtggagcaggacaagaacacccaggaggtcttcgcccaggtgaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctgggggacatcgcggcccgcgacctcatctgcgcccagaagttcaacggcctgaccgtcctgccgcccctcctgaccgacgagatgatcgcccagtacaccagcgccctgctcgcggggaccatcacgtccggctggaccttcggggccggcgccgccctgcagatccccttcgcgatgcagatggcctaccggttcaacggcatcggggtgacccagaacgtgctgtacgagaaccagaagctcatcgccaaccagttcaacagcgccatcggcaagatccaggactccctgagctccaccgccagcgcgctggggaagctccaggacgtcgtgaaccagaacgcccaggccctgaacacgctggtgaagcagctctccagcaacttcggcgccatctccagcgtcctgaacgacatcctgtcccgcctcgacaaggtggaggccgaggtgcagatcgaccggctgatcaccgggcgcctgcagagcctccagacctacgtcacccagcagctgatccgggcggccgagatccgcgccagcgccaacctggccgcgaccaagatgtccgagtgcgtgctcggccagagcaagcgggtggacttctgcggcaaggggtaccacctgatgtccttcccccagagcgccccgcacggcgtcgtgttcctgcacgtcacgtacgtgcccgcccaggagaagaacttcaccaccgcccccgcgatctgccacgacgggaaggcccacttcccccgcgagggcgtgttcgtctccaacgggacccactggttcgtgacgcagcggaacttctacgagccgcagatcatcaccaccgacaacaccttcgtgagcggcaactgcgacgtcgtgatcggcatcgtgaacaacacggtctacgaccccctccagcccgagctggactccttcaaggaggagctggacaagtacttcaagaaccacaccagccccgacgtggacctcggggacatctccggcatcaacgccagcgtggtcaacatccagaaggagatcgaccgcctgaacgaggtggccaagaacctgaacgagtccctcatcgacctgcaggagctggggaagtacgagcagtacatcaagtggccgtggtacatctggctcggcttcatcgccggcctgatcgcgatcgtgatggtcaccatcatgctgtgctgcatgaccagctgctgctcctgcctcaaggggtgctgcagctgcggctcctgctgcaagttcgacgaggacgacagcgagcccgtgctgaagggggtgaagctgcactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12289 - RNA, 4094 nt, synthetic construct
  misc_feature 1..4094: note = SARS-CoV-2/England/200990660/2020__EPI_ISL_414523 spike protein mRNA gc (1-1273)
  source 1..4094: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacaaggtcgaggccgaggtgcagatcgaccggctgatcaccggccgcctccagagcctgcagacctacgtgacccagcagctgatccgggcggccgagatccgcgccagcgccaacctcgccgcgaccaagatgtccgagtgcgtcctgggccagagcaagcgggtggacttctgcgggaagggctaccacctgatgtccttcccccagagcgccccgcacggggtggtcttcctccacgtgacgtacgtccccgcccaggagaagaacttcaccaccgcccccgcgatctgccacgacggcaaggcccacttcccccgcgagggggtgttcgtgtccaacggcacccactggttcgtcacgcagcggaacttctacgagccgcagatcatcaccaccgacaacaccttcgtgagcggcaactgcgacgtggtcatcgggatcgtgaacaacacggtgtacgaccccctgcagcccgagctggactccttcaaggaggagctcgacaagtacttcaagaaccacaccagccccgacgtcgacctgggcgacatctccgggatcaacgccagcgtggtgaacatccagaaggagatcgaccgcctgaacgaggtcgccaagaacctcaacgagtccctgatcgacctgcaggagctcggcaagtacgagcagtacatcaagtggccgtggtacatctggctgggcttcatcgccgggctgatcgcgatcgtgatggtgaccatcatgctctgctgcatgaccagctgctgctcctgcctgaagggctgctgcagctgcgggtcctgctgcaagttcgacgaggacgacagcgagctggtcctcaagggcgtgaagctgcactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12290 - RNA, 4094 nt, synthetic construct
  misc_feature 1..4094: note = SARS-CoV-2/Australia/NSW09/2020__EPI_ISL_413595 spike protein mRNA gc (1-1273)
  source 1..4094: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagcttcaccgcctccgcgctcgggaagctgcaggacgtggtcaaccagaacgcccaggccctgaacacgctcgtgaagcagctgagctccaacttcggcgccatcagctccgtgctgaacgacatcctcagccgcctggacaaggtcgaggccgaggtgcagatcgaccggctgatcaccgggcgcctccagtccctgcagacctacgtgacccagcagctgatccgggcggccgagatccgcgccagcgccaacctcgccgcgaccaagatgagcgagtgcgtcctgggccagtccaagcgggtggacttctgcggcaaggggtaccacctgatgagcttcccccagtccgccccgcacggcgtggtcttcctccacgtgacgtacgtccccgcccaggagaagaacttcaccaccgcccccgcgatctgccacgacgggaaggcccacttcccccgcgagggcgtgttcgtgagcaacgggacccactggttcgtcacgcagcggaacttctacgagccgcagatcatcaccaccgacaacaccttcgtgtccggcaactgcgacgtggtcatcggcatcgtgaacaacacggtgtacgaccccctgcagcccgagctggacagcttcaaggaggagctcgacaagtacttcaagaaccacacctcccccgacgtcgacctgggggacatcagcggcatcaacgcctccgtggtgaacatccagaaggagatcgaccgcctgaacgaggtcgccaagaacctcaacgagagcctgatcgacctgcaggagctcgggaagtacgagcagtacatcaagtggccgtggtacatctggctgggcttcatcgccggcctgatcgcgatcgtgatggtgaccatcatgctctgctgcatgacctcctgctgcagctgcctgaaggggtgctgctcctgcggcagctgctgcaagttcgacgaggacgactccgagcccgtcctgaagggggtgaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12291 - RNA, 4094 nt, synthetic construct
  misc_feature 1..4094: note = SARS-CoV-2/Australia/NSW10/2020__EPI_ISL_413596 spike protein mRNA gc (1-1273)
  source 1..4094: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgcttcaagttcgacgaggacgacagcgagcccgtcctgaagggggtgaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12292 - RNA, 4094 nt, synthetic construct
  misc_feature 1..4094: note SARS-CoV-2/Switzerland/1000477797/2020__EPI_ISL_413023 spike protein mRNA gc (1-1273)
  source 1..4094: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaacatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacaaggtcgaggccgaggtgcagatcgaccggctgatcaccggccgcctccagagcctgcagacctacgtgacccagcagctgatccgggcggccgagatccgcgccagcgccaacctcgccgcgaccaagatgtccgagtgcgtcctgggccagagcaagcgggtggacttctgcgggaagggctaccacctgatgtccttcccccagagcgccccgcacggggtggtcttcctccacgtgacgtacgtccccgcccaggagaagaacttcaccaccgcccccgcgatctgccacgacggcaaggcccacttcccccgcgagggggtgttcgtgtccaacggcacccactggttcgtcacgcagcggaacttctacgagccgcagatcatcaccaccgacaacaccttcgtgagcggcaactgcgacgtggtcatcgggatcgtgaacaacacggtgtacgaccccctgcagcccgagctggactccttcaaggaggagctcgacaagtacttcaagaaccacaccagccccgacgtcgacctgggcgacatctccgggatcaacgccagcgtggtgaacatccagaaggagatcgaccgcctgaacgaggtcgccaagaacctcaacgagtccctgatcgacctgcaggagctcggcaagtacgagcagtacatcaagtggccgtggtacatctggctgggcttcatcgccgggctgatcgcgatcgtgatggtgaccatcatgctctgctgcatgaccagctgctgctcctgcctgaagggctgctgcagctgcgggtcctgctgcaagttcgacgaggacgacagcgagcccgtcctgaagggcgtgaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12293 - RNA, 4094 nt, synthetic construct
  misc_feature 1..4094: note = SARS-CoV-2/Belgium/BA-02291/2020__EPI_ISL_415159 spike protein mRNA gc (1-1273)
  source 1..4094: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccggcgcagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgcgtggtcgtgctgagcttcgagctcctgcccgcccccgccacggtgtgcggcccgaagaagtccaccaacctggtcaagaacaagtgcgtgaacttcaacttcaacggcctcaccgggaccggcgtgctgaccgagtccaacaagaagttcctgcccttccagcagttcgggcgcgacatcgccgacacgaccgacgcggtccgggacccccagaccctggagatcctcgacatcaccccgtgcagcttcggcggggtgtccgtgatcacgcccggcaccaacaccagcaaccaggtcgccgtgctgtaccagggcgtgaactgcaccgaggtccccgtggccatccacgccgaccagctgacgcccacctggcgcgtgtactccaccgggagcaacgtcttccagacccgggccggctgcctcatcggggcggagcacgtgaacaactcctacgagtgcgacatcccgatcggcgccggcatctgcgccagctaccagacgcagaccaacagcccccgccgggcccgcagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgggcgctgacgggcatcgccgtggagcaggacaagaacacccaggaggtgttcgcccaggtcaagcagatctacaagaccccgcccatcaaggacttcgggggcttcaacttcagccagatcctgcccgacccctccaagccgagcaagcgctccttcatcgaggacctcctgttcaacaaggtgaccctggccgacgccggcttcatcaagcagtacggggactgcctcggcgacatcgcggcccgggacctgatctgcgcccagaagttcaacgggctgacggtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccgcttcaacgggatcggcgtcacccagaacgtgctctacgagaaccagaagctgatcgccaaccagttcaacagcgccatcgggaagatccaggactccctgagctccgccgcgcccgccctcggcaagctgcaggacgtggtcaaccagaacgcccaggccctgaacaccctcgtgaagcagctgagctccaacttcggggccatcagctccgtgctgaacgacatcctcagccggctggacaaggtcgaggcggaggtgcagatcgaccgcctgatcacgggccggctccagtccctgcagacctacgtgacccagcagctgatccgcgccgccgagatccgggccagcgccaacctcgcggccaccaagatgagcgagtgcgtcctgggccagtccaagcgcgtggacttctgcgggaagggctaccacctgatgagcttcccccagtccgcgccccacggggtggtcttcctccacgtgacctacgtccccgcccaggagaagaacttcacgaccgccccggccatctgccacgacggcaaggcccacttcccccgggagggggtgttcgtgagcaacggcacccactggttcgtcacccagcgcaacttctacgagccccagatcatcacgaccgacaacaccttcgtgtccggcaactgcgacgtggtcatcgggatcgtgaacaacaccgtgtacgaccccctgcagccggagctggacagcttcaaggaggagctcgacaagtacttcaagaaccacacgtcccccgacgtcgacctgggcgacatcagcgggatcaacgcctccgtggtgaacatccagaaggagatcgaccggctgaacgaggtcgccaagaacctcaacgagagcctgatcgacctgcaggagctcggcaagtacgagcagtacatcaagtggccctggtacatctggctgggcttcatcgcggggctgatcgccatcgtgatggtgaccatcatgctctgctgcatgacctcctgctgcagctgcctgaagggctgctgctcctgcgggagctgctgcaagttcgacgaggacgactccgagccggtcctgaagggcgtgaagctccactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12294 - RNA, 4094 nt, synthetic construct
  misc_feature 1..4094: note = SARS-CoV-2/USA/WA8-UW5/2020__EPI_ISL_413486 spike protein mRNA gc (1-1273)
  source 1..4094: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagtacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12295 - RNA, 4094 nt, synthetic construct
  misc_feature 1..4094: note = SARS-CoV-2/England/20102000506/2020__EPI_ISL_415147 spike protein mRNA gc (1-1273)
  source 1..4094: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacgggtactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacaaggtcgaggccgaggtgcagatcgaccggctgatcaccggccgcctccagagcctgcagacctacgtgacccagcagctgatccgggcggccgagatccgcgccagcgccaacctcgccgcgaccaagatgtccgagtgcgtcctgggccagagcaagcgggtggacttctgcgggaagggctaccacctgatgtccttcccccagagcgccccgcacggggtggtcttcctccacgtgacgtacgtccccgcccaggagaagaacttcaccaccgcccccgcgatctgccacgacggcaaggcccacttcccccgcgagggggtgttcgtgtccaacggcacccactggttcgtcacgcagcggaacttctacgagccgcagatcatcaccaccgacaacaccttcgtgagcggcaactgcgacgtggtcatcgggatcgtgaacaacacggtgtacgaccccctgcagcccgagctggactccttcaaggaggagctcgacaagtacttcaagaaccacaccagccccgacgtcgacctgggcgacatctccgggatcaacgccagcgtggtgaacatccagaaggagatcgaccgcctgaacgaggtcgccaagaacctcaacgagtccctgatcgacctgcaggagctcggcaagtacgagcagtacatcaagtggccgtggtacatctggctgggcttcatcgccgggctgatcgcgatcgtgatggtgaccatcatgctctgctgcatgaccagctgctgctcctgcctgaagggctgctgcagctgcgggtcctgctgcaagttcgacgaggacgacagcgagcccgtcctgaagggcgtgaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12296 - RNA, 4094 nt, synthetic construct
  misc_feature 1..4094: note = SARS-CoV-2/Belgium/VAG-03013/2020__EPI_ISL_415155 spike protein mRNA gc (1-1273)
  source 1..4094: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccacggcgctcggcaagctgcaggacgtggtcaaccagaacgcccaggccctgaacaccctcgtgaagcagctgagctccaacttcggggccatcagctccgtgctgaacgacatcctcagccgcctggacaaggtcgaggccgaggtgcagatcgaccggctgatcaccggccgcctccagtccctgcagacctacgtgacccagcagctgatccgggcggccgagatccgcgccagcgccaacctcgccgcgacgaagatgagcgagtgcgtcctgggccagtccaagcgggtggacttctgcgggaagggctaccacctgatgagcttcccccagtccgccccgcacggggtggtcttcctccacgtgacctacgtccccgcccaggagaagaacttcaccaccgcccccgcgatctgccacgacggcaaggcccacttcccccgcgagggggtgttcgtgagcaacggcacgcactggttcgtcacccagcggaacttctacgagccgcagatcatcaccaccgacaacacgttcgtgtccggcaactgcgacgtggtcatcgggatcgtgaacaacaccgtgtacgaccccctgcagcccgagctggacagcttcaaggaggagctcgacaagtacttcaagaaccacacctcccccgacgtcgacctgggcgacatcagcgggatcaacgcctccgtggtgaacatccagaaggagatcgaccgcctgaacgaggtcgccaagaacctcaacgagagcctgatcgacctgcaggagctcggcaagtacgagcagtacatcaagtggccgtggtacatctggctgggcttcatcgccgggctgatcgcgatcgtgatggtgaccatcatgctctgctgcatgacgtcctgctgcagctgcctgaagggctgctgctcctgcgggagctgctgcaagttcgacgaggacgactccgagcccgtcctgaagggcgtgaagctccactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12297 - RNA, 4094 nt, synthetic construct
  misc_feature 1..4094: note = SARS-CoV-2/Belgium/BC-03016/2020__EPI_ISL_415157 spike protein mRNA gc (1-1273)
  source 1..4094: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgcccccgcgctcggcaagctgcaggacgtggtcaaccagaacgcccaggccctgaacacgctcgtgaagcagctgagctccaacttcggggccatcagctccgtgctgaacgacatcctcagccgcctggacaaggtcgaggccgaggtgcagatcgaccggctgatcaccggccgcctccagtccctgcagacctacgtgacccagcagctgatccgggcggccgagatccgcgccagcgccaacctcgccgcgaccaagatgagcgagtgcgtcctgggccagtccaagcgggtggacttctgcgggaagggctaccacctgatgagcttcccgcagtccgcgccccacggggtggtcttcctccacgtgacgtacgtccccgcccaggagaagaacttcaccaccgcccccgccatctgccacgacggcaaggcccacttcccgcgcgagggggtgttcgtgagcaacggcacccactggttcgtcacgcagcggaacttctacgagccccagatcatcaccaccgacaacaccttcgtgtccggcaactgcgacgtggtcatcgggatcgtgaacaacacggtgtacgaccccctgcagcccgagctggacagcttcaaggaggagctcgacaagtacttcaagaaccacacctccccggacgtcgacctgggcgacatcagcgggatcaacgcctccgtggtgaacatccagaaggagatcgaccgcctgaacgaggtcgccaagaacctcaacgagagcctgatcgacctgcaggagctcggcaagtacgagcagtacatcaagtggccctggtacatctggctgggcttcatcgccgggctgatcgcgatcgtgatggtgaccatcatgctctgctgcatgacctcctgctgcagctgcctgaagggctgctgctcctgcgggagctgctgcaagttcgacgaggacgactccgagcccgtcctgaagggcgtgaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12298 - RNA, 4094 nt, synthetic construct
  misc_feature 1..4094: note = SARS-CoV-2/Germany/BavPat3/2020__EPI_ISL_414521 spike protein mRNA gc (1-1273)
  source 1..4094: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccagcaggtcttcgcccaggtgaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12299 - RNA, 4094 nt, synthetic construct
  misc_feature 1..4094: note = SARS-CoV-2/France/HF1805/2020__EPI_ISL_414628 spike protein mRNA gc (1-1273)
  source 1..4094: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacaaggtcgaggccgaggtgcagatcgaccggctgatcaccggccgcctccagagcctgcagacctacgtgacccagcagctgatccgggcggccgagatccgcgccagcgccaacctcgccgcgaccaagatgtccgagtgcgtcctgggccagagcaagcgggtggacttctgcgggaagggctaccacctgatgtccttcccccagagcgccccgcacggggtggtcttcctccacgtgacgtacgtccccgcccaggagaagaacttcaccaccgcccccgcgatctgccacgacggcaaggcccacttcccccgcgagggggtgttcgtgtccaacggcacccactggttcgtcacgcagcggaacttctacgagccgcagatcatcaccaccgacaacaccttcgtgagcggcaactgcgacgtggtcatcggggtggtgaacaacacggtctacgaccccctgcagcccgagctggactccttcaaggaggagctcgacaagtacttcaagaaccacaccagccccgacgtggacctgggcgacatctccgggatcaacgccagcgtggtcaacatccagaaggagatcgaccgcctgaacgaggtggccaagaacctcaacgagtccctgatcgacctgcaggagctcggcaagtacgagcagtacatcaagtggccgtggtacatctggctgggcttcatcgccgggctgatcgcgatcgtgatggtcaccatcatgctctgctgcatgaccagctgctgctcctgcctgaagggctgctgcagctgcgggtcctgctgcaagttcgacgaggacgacagcgagcccgtgctgaagggcgtgaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12300 - RNA, 4094 nt, synthetic construct
  misc_feature 1..4094: note SARS-CoV-2/Netherlands/ZuidHolland_9/2020__EPI_ISL_414445 spike protein mRNA gc (1-1273)
  source 1..4094: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgtgcagaagttcaacgggctgaccgtcctcccgcccctgctgaccgacgagatgatcgcccagtacaccagcgccctcctggccggcaccatcacgtccgggtggaccttcggcgcgggcgccgccctgcagatccccttcgccatgcagatggcgtaccggttcaacgggatcggcgtgacccagaacgtgctctacgagaaccagaagctgatcgccaaccagttcaacagcgccatcgggaagatccaggactccctgagctccaccgccagcgccctcggcaagctgcaggacgtcgtgaaccagaacgcgcaggccctgaacacgctcgtgaagcagctgtccagcaacttcggggccatctccagcgtcctgaacgacatcctctcccgcctggacaaggtggaggccgaggtgcagatcgaccggctgatcaccggccgcctccagagcctgcagacctacgtcacccagcagctgatccgggccgcggagatccgcgccagcgccaacctcgccgccaccaagatgtccgagtgcgtgctgggccagagcaagcgggtggacttctgcgggaagggctaccacctgatgtccttcccccagagcgcgccgcacggggtcgtgttcctccacgtcacgtacgtgcccgcccaggagaagaacttcaccaccgcccccgccatctgccacgacggcaaggcgcacttcccccgcgagggggtgttcgtctccaacggcacccactggttcgtgacgcagcggaacttctacgagccgcagatcatcaccaccgacaacaccttcgtgagcggcaactgcgacgtcgtgatcgggatcgtgaacaacacggtctacgaccccctgcagcccgagctggactccttcaaggaggagctcgacaagtacttcaagaaccacaccagccccgacgtggacctgggcgacatctccgggatcaacgccagcgtggtcaacatccagaaggagatcgaccgcctgaacgaggtggccaagaacctcaacgagtccctgatcgacctgcaggagctcggcaagtacgagcagtacatcaagtggccgtggtacatctggctgggcttcatcgccgggctgatcgccatcgtgatggtcaccatcatgctctgctgcatgaccagctgctgctcctgcctgaagggctgctgcagctgcgggtcctgctgcaagttcgacgaggacgacagcgagcccgtgctgaagggcgtgaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12301 - RNA, 4094 nt, synthetic construct
  misc_feature 1..4094: note = SARS-CoV-2/Finland/FIN03032020A/2020__EPI_ISL_413602 spike protein mRNA gc (1-1273)
  source 1..4094: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcagctggaactccaacaacctcgacagcaaggtcgggggcaactacaactacctgtaccgcctgttccggaagtccaacctcaagcccttcgagcgcgacatcagcaccgagatctaccaggcgggctccaccccctgcaacggggtggagggcttcaactgctacttccccctgcagagctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgccgtccgcgacccccagaccctggagatcctcgacatcaccccctgctccttcggcggggtgagcgtgatcacgccgggcaccaacacctccaaccaggtcgcggtgctgtaccagggcgtgaactgcaccgaggtccccgtggccatccacgccgaccagctgacgcccacctggcgggtgtacagcaccgggtccaacgtcttccagacccgcgccggctgcctcatcggggccgagcacgtgaacaacagctacgagtgcgacatccccatcggcgcgggcatctgcgcctcctaccagacgcagaccaacagcccgcggcgcgcccggtccgtggccagccagtccatcatcgcgtacaccatgagcctgggggccgagaactccgtcgcctacagcaacaactccatcgccatccccaccaacttcacgatcagcgtgaccaccgagatcctgcccgtgagcatgaccaagacgtccgtcgactgcaccatgtacatctgcggcgacagcaccgagtgctccaacctcctgctgcagtacgggagcttctgcacccagctcaaccgcgccctgacgggcatcgcggtggagcaggacaagaacacccaggaggtgttcgcccaggtcaagcagatctacaagacgcccccgatcaaggacttcgggggcttcaacttctcccagatcctgcccgaccccagcaagccctccaagcggagcttcatcgaggacctcctgttcaacaaggtgaccctggccgacgccggcttcatcaagcagtacggggactgcctcggcgacatcgccgcgcgcgacctgatctgcgcccagaagttcaacgggctgaccgtgctcccgcccctgctgaccgacgagatgatcgcccagtacacctccgccctcctggccggcaccatcacgagcgggtggaccttcggcgcgggcgccgccctgcagatccccttcgccatgcagatggcgtaccggttcaacgggatcggcgtcacccagaacgtgctctacgagaaccagaagctgatcgccaaccagttcaactccgccatcgggaagatccaggacagcctgtccagcaccgcctccgccctcggcaagctgcaggacgtggtcaaccagaacgcgcaggccctgaacacgctcgtgaagcagctgagctccaacttcggggccatcagctccgtgctgaacgacatcctcagccgcctggacaaggtcgaggccgaggtgcagatcgaccggctgatcaccggccgcctccagagcctgcagacctacgtgacccagcagctgatccgggccgcggagatccgcgcctccgccaacctcgccgccaccaagatgagcgagtgcgtcctgggccagtccaagcgggtggacttctgcgggaagggctaccacctgatgagcttcccccagtccgcgccgcacggggtggtcttcctccacgtgacgtacgtccccgcccaggagaagaacttcaccaccgcccccgccatctgccacgacggcaaggcgcacttcccccgcgagggggtgttcgtgagcaacggcacccactggttcgtcacgcagcggaacttctacgagccgcagatcatcaccaccgacaacaccttcgtgtccggcaactgcgacgtggtcatcgggatcgtgaacaacacggtgtacgaccccctgcagcccgagctggacagcttcaaggaggagctcgacaagtacttcaagaaccacacctcccccgacgtcgacctgggcgacatcagcgggatcaacgcctccgtggtgaacatccagaaggagatcgaccgcctgaacgaggtcgccaagaacctcaacgagagcctgatcgacctgcaggagctcggcaagtacgagcagtacatcaagtggccgtggtacatctggctgggcttcatcgccgggctgatcgccatcgtgatggtgaccatcatgctctgctgcatgacctcctgctgcagctgcctgaagggctgctgctcctgcgggagctgctgcaagttcgacgaggacgactccgagcccgtcctgaagggcgtgaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12302 - RNA, 4094 nt, synthetic construct
  misc_feature 1..4094: note = SARS-CoV-2/France/GE1977/2020__EPI_ISL_414632 spike protein mRNA gc (1-1273)
  source 1..4094: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgttcagcaccgcctccgcgctcggcaagctgcaggacgtggtcaaccagaacgcccaggccctgaacacgctcgtgaagcagctgagctccaacttcggggccatcagctccgtgctgaacgacatcctcagccgcctggacaaggtcgaggccgaggtgcagatcgaccggctgatcaccggccgcctccagtccctgcagacctacgtgacccagcagctgatccgggcggccgagatccgcgccagcgccaacctcgccgcgaccaagatgagcgagtgcgtcctgggccagtccaagcgggtggacttctgcgggaagggctaccacctgatgagcttcccccagtccgccccgcacggggtggtcttcctccacgtgacgtacgtccccgcccaggagaagaacttcaccaccgcccccgcgatctgccacgacggcaaggcccacttcccccgcgagggggtgttcgtgagcaacggcacccactggttcgtcacgcagcggaacttctacgagccgcagatcatcaccaccgacaacaccttcgtgtccggcaactgcgacgtggtcatcgggatcgtgaacaacacggtgtacgaccccctgcagcccgagctggacagcttcaaggaggagctcgacaagtacttcaagaaccacacctcccccgacgtcgacctgggcgacatcagcgggatcaacgcctccgtggtgaacatccagaaggagatcgaccgcctgaacgaggtcgccaagaacctcaacgagagcctgatcgacctgcaggagctcggcaagtacgagcagtacatcaagtggccgtggtacatctggctgggcttcatcgccgggctgatcgcgatcgtgatggtgaccatcatgctctgctgcatgacctcctgctgcagctgcctgaagggctgctgctcctgcgggagctgctgcaagttcgacgaggacgactccgagcccgtcctgaagggcgtgaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12303 - RNA, 4094 nt, synthetic construct
  misc_feature 1..4094: note = SARS-CoV-2/Finland/FIN-313/2020__EPI_ISL_414641 spike protein mRNA gc (1-1273)
  source 1..4094: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttcaagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacaaggtcgaggccgaggtgcagatcgaccggctgatcaccggccgcctccagagcctgcagacctacgtgacccagcagctgatccgggcggccgagatccgcgccagcgccaacctcgccgcgaccaagatgtccgagtgcgtcctgggccagagcaagcgggtggacttctgcgggaagggctaccacctgatgtccttcccccagagcgccccgcacggggtggtcttcctccacgtgacgtacgtccccgcccaggagaagaacttcaccaccgcccccgcgatctgccacgacggcaaggcccacttcccccgcgagggggtgttcgtgtccaacggcacccactggttcgtcacgcagcggaacttctacgagccgcagatcatcaccaccgacaacaccttcgtgagcggcaactgcgacgtggtcatcgggatcgtgaacaacacggtgtacgaccccctgcagcccgagctggactccttcaaggaggagctcgacaagtacttcaagaaccacaccagccccgacgtcgacctgggcgacatctccgggatcaacgccagcgtggtgaacatccagaaggagatcgaccgcctgaacgaggtcgccaagaacctcaacgagtccctgatcgacctgcaggagctcggcaagtacgagcagtacatcaagtggccgtggtacatctggctgggcttcatcgccgggctgatcgcgatcgtgatggtgaccatcatgctctgctgcatgaccagctgctgctcctgcctgaagggctgctgcagctgcgggtcctgctgcaagttcgacgaggacgacagcgagcccgtcctgaagggcgtgaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12304 - RNA, 4094 nt, synthetic construct
  misc_feature 1..4094: note SARS-CoV-2/Netherlands/ZuidHolland_2/2020__EPI_ISL_414556 spike protein mRNA gc (1-1273)
  source 1..4094: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccctggagcaggacaagaacacccaggaggtgttcgcccaggtgaagcagatctacaagacgcccccgatcaaggacttcgggggcttcaacttcagccagatcctccccgacccctccaagcccagcaagcggtccttcatcgaggacctgctgttcaacaaggtcaccctcgccgacgccggcttcatcaagcagtacggggactgcctgggcgacatcgcggcccgcgacctgatctgcgcccagaagttcaacgggctcaccgtgctgccgcccctgctcaccgacgagatgatcgcccagtacaccagcgccctgctggcgggcaccatcacgtccgggtggaccttcggcgccggcgccgccctccagatccccttcgcgatgcagatggcctaccggttcaacgggatcggcgtgacccagaacgtcctgtacgagaaccagaagctgatcgccaaccagttcaacagcgccatcgggaagatccaggactccctcagctccaccgccagcgcgctgggcaagctgcaggacgtggtgaaccagaacgcccaggccctcaacacgctggtcaagcagctgtccagcaacttcggggccatctccagcgtgctcaacgacatcctgtcccgcctggacaaggtggaggccgaggtccagatcgaccggctcatcaccggccgcctgcagagcctgcagacctacgtgacccagcagctcatccgggcggccgagatccgcgccagcgccaacctggccgcgaccaagatgtccgagtgcgtgctgggccagagcaagcgggtcgacttctgcgggaagggctaccacctcatgtccttcccccagagcgccccgcacggggtggtgttcctgcacgtcacgtacgtgcccgcccaggagaagaacttcaccaccgcccccgcgatctgccacgacggcaaggcccacttcccccgcgagggggtcttcgtgtccaacggcacccactggttcgtgacgcagcggaacttctacgagccgcagatcatcaccaccgacaacaccttcgtcagcggcaactgcgacgtggtgatcgggatcgtcaacaacacggtgtacgaccccctgcagcccgagctcgactccttcaaggaggagctggacaagtacttcaagaaccacaccagccccgacgtggacctgggcgacatctccgggatcaacgccagcgtcgtgaacatccagaaggagatcgaccgcctcaacgaggtggccaagaacctgaacgagtccctgatcgacctccaggagctgggcaagtacgagcagtacatcaagtggccgtggtacatctggctgggcttcatcgccgggctcatcgcgatcgtcatggtgaccatcatgctgtgctgcatgaccagctgctgctcctgcctgaagggctgctgcagctgcgggtcctgctgcaagttcgacgaggacgacagcgagcccgtgctcaagggcgtcaagctgcactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12305 - RNA, 4094 nt, synthetic construct
  misc_feature 1..4094: note = SARS-CoV-2/USA/WA-UW31/2020__EPI_ISL_414618 spike protein mRNA gc (1-1273)
  source 1..4094: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggccgagggcttcaactgctacttccccctgcagtcctacgggttccagccgaccaacggcgtggggtaccagccctaccgggtggtggtcctgagcttcgagctcctgcacgcccccgccacggtgtgcggccccaagaagtccaccaacctggtgaagaacaagtgcgtcaacttcaacttcaacggcctcaccgggaccggcgtgctgaccgagagcaacaagaagttcctgccgttccagcagttcgggcgcgacatcgcggacacgaccgacgccgtgcgcgacccccagaccctggagatcctcgacatcaccccctgcagcttcggcggggtctccgtgatcacgccgggcaccaacaccagcaaccaggtggccgtcctgtaccaggacgtgaactgcaccgaggtgcccgtcgccatccacgccgaccagctgacgcccacctggcgggtgtactccaccggcagcaacgtgttccagacccgcgcggggtgcctcatcggcgccgagcacgtcaacaactcctacgagtgcgacatccccatcggggccggcatctgcgccagctaccagacgcagaccaactccccgcggcgcgcgcggagcgtggcctcccagagcatcatcgcctacaccatgtccctgggcgccgagaacagcgtggcctactccaacaacagcatcgcgatccccaccaacttcacgatctccgtcaccaccgagatcctgcccgtgagcatgaccaagacgagcgtggactgcaccatgtacatctgcggggactccaccgagtgcagcaacctcctgctgcagtacggctccttctgcacccagctcaaccgcgccctgacggggatcgccgtcgagcaggacaagaacacccaggaggtgttcgcccaggtgaagcagatctacaagacgcccccgatcaaggacttcggcgggttcaacttcagccagatcctgcccgacccctccaagcccagcaagcggtccttcatcgaggacctcctgttcaacaaggtcaccctggccgacgcgggcttcatcaagcagtacggcgactgcctcggggacatcgccgcccgcgacctgatctgcgcccagaagttcaacggcctgaccgtgctcccgcccctgctgaccgacgagatgatcgcccagtacaccagcgcgctcctggccgggaccatcacgtccggctggaccttcggggccggcgccgcgctgcagatccccttcgccatgcagatggcctaccggttcaacggcatcggggtgacccagaacgtcctctacgagaaccagaagctgatcgccaaccagttcaacagcgccatcggcaagatccaggactccctgagctccaccgcgagcgccctcgggaagctgcaggacgtggtgaaccagaacgcccaggccctgaacacgctcgtcaagcagctgtccagcaacttcggcgccatctccagcgtgctgaacgacatcctctcccgcctggacaaggtggaggcggaggtccagatcgaccggctgatcaccgggcgcctccagagcctgcagacctacgtgacccagcagctgatccgggccgccgagatccgcgccagcgccaacctcgcggccaccaagatgtccgagtgcgtgctgggccagagcaagcgggtcgacttctgcggcaaggggtaccacctgatgtccttcccccagagcgccccgcacggcgtggtgttcctccacgtcacgtacgtgcccgcccaggagaagaacttcaccaccgcgcccgccatctgccacgacgggaaggcccacttcccccgcgagggcgtcttcgtgtccaacgggacccactggttcgtgacgcagcggaacttctacgagccgcagatcatcaccaccgacaacaccttcgtcagcggcaactgcgacgtggtgatcggcatcgtcaacaacacggtgtacgaccccctgcagcccgagctggactccttcaaggaggagctcgacaagtacttcaagaaccacaccagccccgacgtggacctgggggacatctccggcatcaacgccagcgtcgtgaacatccagaaggagatcgaccgcctgaacgaggtggccaagaacctcaacgagtccctgatcgacctgcaggagctcgggaagtacgagcagtacatcaagtggccgtggtacatctggctgggcttcatcgcgggcctgatcgccatcgtcatggtgaccatcatgctctgctgcatgaccagctgctgctcctgcctgaaggggtgctgcagctgcggctcctgctgcaagttcgacgaggacgacagcgagcccgtgctgaagggggtcaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12306 - RNA, 4094 nt, synthetic construct
  misc_feature 1..4094: note = SARS-CoV-2/South Korea/SNU01/2020__EPI_ISL_411929 spike protein mRNA gc (1-1273)
  source 1..4094: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttctgggccctcgagcccctggtggacctgcccatcggcatcaacatcacccgcttccagaccctcctggccctgcaccggagctacctcacgccgggggactccagcagcggctggaccgcgggcgccgccgcctactacgtggggtacctgcagccccgcaccttcctgctcaagtacaacgagaacggcaccatcacggacgcggtcgactgcgccctggaccccctgtccgagaccaagtgcaccctcaagagcttcaccgtggagaaggggatctaccagacgtccaacttccgggtgcagcccaccgagagcatcgtccgcttcccgaacatcaccaacctgtgccccttcggcgaggtgttcaacgccacccggttcgcctccgtctacgcctggaaccgcaagcggatcagcaactgcgtggcggactactccgtgctgtacaacagcgcctccttcagcacgttcaagtgctacggcgtctcccccaccaagctcaacgacctgtgcttcaccaacgtgtacgccgacagcttcgtgatccgcggggacgaggtccggcagatcgcccccggccagaccgggaagatcgccgactacaactacaagctgccggacgacttcacgggctgcgtgatcgcgtggaactccaacaacctcgacagcaaggtcgggggcaactacaactacctgtaccgcctgttccggaagtccaacctcaagcccttcgagcgcgacatcagcaccgagatctaccaggccggctccaccccctgcaacggggtggagggcttcaactgctacttccccctgcagagctacgggttccagccgaccaacggcgtggggtaccagccctaccgggtggtcgtgctgtccttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgagcgtgatcacgccgggcaccaacacctccaaccaggtcgccgtgctgtaccaggacgtgaactgcaccgaggtccccgtggccatccacgccgaccagctgacgcccacctggcgggtgtacagcaccggctccaacgtcttccagacccgcgccgggtgcctcatcggcgcggagcacgtgaacaacagctacgagtgcgacatccccatcggggccggcatctgcgcctcctaccagacgcagaccaacagcccgcggcgcgcccggtccgtggcgagccagtccatcatcgcctacaccatgagcctgggcgccgagaactccgtcgcctacagcaacaactccatcgccatccccaccaacttcacgatcagcgtgaccaccgagatcctgcccgtgtccatgaccaagacgagcgtcgactgcaccatgtacatctgcggggacagcaccgagtgctccaacctcctgctgcagtacggcagcttctgcacccagctcaaccgcgcgctgacggggatcgccgtggagcaggacaagaacacccaggaggtgttcgcccaggtcaagcagatctacaagacgcccccgatcaaggacttcggcgggttcaacttctcccagatcctgcccgaccccagcaagccctccaagcggagcttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacacctccgccctcctggcggggaccatcacgagcggctggaccttcggggccggcgccgccctgcagatccccttcgcgatgcagatggcctaccggttcaacggcatcggggtcacccagaacgtgctctacgagaaccagaagctgatcgccaaccagttcaactccgccatcggcaagatccaggacagcctgtccagcaccgcctccgcgctcgggaagctgcaggacgtggtcaaccagaacgcccaggccctgaacacgctcgtgaagcagctgagctccaacttcggcgccatcagctccgtgctgaacgacatcctcagccgcctggacaaggtcgaggccgaggtgcagatcgaccggctgatcaccgggcgcctccagtccctgcagacctacgtgacccagcagctgatccgggcggccgagatccgcgccagcgccaacctcgccgcgaccaagatgagcgagtgcgtcctgggccagtccaagcgggtggacttctgcggcaaggggtaccacctgatgagcttcccccagtccgccccgcacggcgtggtcttcctccacgtgacgtacgtccccgcccaggagaagaacttcaccaccgcccccgcgatctgccacgacgggaaggcccacttcccccgcgagggcgtgttcgtgagcaacgggacccactggttcgtcacgcagcggaacttctacgagccgcagatcatcaccaccgacaacaccttcgtgtccggcaactgcgacgtggtcatcggcatcgtgaacaacacggtgtacgaccccctgcagcccgagctggacagcttcaaggaggagctcgacaagtacttcaagaaccacacctcccccgacgtcgacctgggggacatcagcggcatcaacgcctccgtggtgaacatccagaaggagatcgaccgcctgaacgaggtcgccaagaacctcaacgagagcctgatcgacctgcaggagctcgggaagtacgagcagtacatcaagtggccgtggtacatctggctgggcttcatcgccggcctgatcgcgatcgtgatggtgaccatcatgctctgctgcatgacctcctgctgcagctgcctgaaggggtgctgctcctgcggcagctgctgcaagttcgacgaggacgactccgagcccgtcctgaagggggtgaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12307 - RNA, 4094 nt, synthetic construct
  misc_feature 1..4094: note = SARS-CoV-2/China/WF0004/2020__EPI_ISL_413694 spike protein mRNA gc (1-1273)
  source 1..4094: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggacggagtccgagttccgggtctacagctccgccaacaactgcaccttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagacgctcctggccctgcaccggtcctacctcaccccgggggacagcagctccggctggaccgcgggcgccgccgcctactacgtggggtacctgcagccccgcaccttcctgctcaagtacaacgagaacggcacgatcaccgacgcggtcgactgcgccctggaccccctgagcgagaccaagtgcaccctcaagtccttcacggtggagaaggggatctaccagaccagcaacttccgggtgcagcccaccgagtccatcgtccgcttcccgaacatcaccaacctgtgccccttcggcgaggtgttcaacgccacgcggttcgccagcgtctacgcctggaaccgcaagcggatctccaactgcgtggcggactacagcgtgctgtacaactccgccagcttctccaccttcaagtgctacggcgtcagccccaccaagctcaacgacctgtgcttcaccaacgtgtacgccgactccttcgtgatccgcggggacgaggtccggcagatcgcccccggccagacggggaagatcgccgactacaactacaagctgccggacgacttcaccggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgacgaacggcgtggggtaccagccctaccgggtggtcgtgctgagcttcgagctcctgcacgcccccgccaccgtgtgcggccccaagaagtccaccaacctggtcaagaacaagtgcgtgaacttcaacttcaacggcctcaccgggaccggcgtgctgacggagagcaacaagaagttcctgccgttccagcagttcgggcgcgacatcgccgacaccaccgacgcggtccgcgacccccagaccctggagatcctcgacatcacgccctgcagcttcggcggggtgtccgtgatcaccccgggcaccaacaccagcaaccaggtcgccgtgctgtaccaggacgtgaactgcacggaggtccccgtggccatccacgccgaccagctgacccccacctggcgggtgtactccaccggcagcaacgtcttccagacgcgcgccgggtgcctcatcggcgcggagcacgtgaacaactcctacgagtgcgacatccccatcggggccggcatctgcgccagctaccagacccagaccaactccccgcggcgcgcccggagcgtggcgtcccagagcatcatcgcctacaccatgtccctgggcgccgagaacagcgtcgcctactccaacaacagcatcgccatccccacgaacttcaccatctccgtgaccaccgagatcctgcccgtgagcatgacgaagaccagcgtcgactgcaccatgtacatctgcggggactccaccgagtgcagcaacctcctgctgcagtacggctccttctgcacgcagctcaaccgcgcgctgaccgggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggacgatcacctccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccacggccagcgcgctcgggaagctgcaggacgtggtcaaccagaacgcccaggccctgaacaccctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgacgaagatgtccgagtgcgtcctgggccagagcaagcggttcgacttctgcggcaaggggtaccacctgatgtccttcccccagagcgccccgcacggcgtggtgttcctccacgtcacctacgtgcccgcccaggagaagaacttcaccaccgcccccgcgatctgccacgacgggaaggcccacttcccccgcgagggcgtcttcgtgtccaacgggacgcactggttcgtgacccagcggaacttctacgagccgcagatcatcaccaccgacaacacgttcgtcagcggcaactgcgacgtggtgatcggcatcgtcaacaacaccgtgtacgaccccctgcagcccgagctggactccttcaaggaggagctcgacaagtacttcaagaaccacaccagccccgacgtggacctgggggacatctccggcatcaacgccagcgtcgtgaacatccagaaggagatcgaccgcctgaacgaggtggccaagaacctcaacgagtccctgatcgacctgcaggagctcgggaagtacgagcagtacatcaagtggccgtggtacatctggctgggcttcatcgccggcctgatcgcgatcgtcatggtgaccatcatgctctgctgcatgacgagctgctgctcctgcctgaaggggtgctgcagctgcggctcctgctgcaagttcgacgaggacgacagcgagcccgtgctgaagggggtcaagctccactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12308 - RNA, 4094 nt, synthetic construct
  misc_feature 1..4094: note = SARS-CoV-2/China/WF0028/2020__EPI_ISL_413791 spike protein mRNA gc (1-1273)
  source 1..4094: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggagtccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12309 - RNA, 4094 nt, synthetic construct
  misc_feature 1..4094: note = SARS-CoV-2/2019-nCoV/USA-CruiseA-18/2020__MT159716.1 spike protein mRNA gc (1-1273)
  source 1..4094: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagctgcgggtctacagctccgccaacaactgcacgttcgagtacgtgagccagcccttcctgatggacctcgagggcaagcaggggaacttcaagaacctgcgcgagttcgtgttcaagaacatcgacggctacttcaagatctactccaagcacaccccgatcaacctggtccgggacctcccccaggggttcagcgccctggagcccctggtggacctccccatcggcatcaacatcacccgcttccagaccctgctggccctccaccggtcctacctgacgccgggggacagcagctccggctggaccgcgggcgccgccgcctactacgtggggtacctgcagccccgcaccttcctcctgaagtacaacgagaacggcaccatcacggacgcggtcgactgcgccctggaccccctcagcgagaccaagtgcaccctgaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctctacaactccgccagcttctccacgttcaagtgctacggcgtcagccccaccaagctgaacgacctgtgcttcaccaacgtgtacgccgactccttcgtgatccgcggggacgaggtccggcagatcgcccccggccagaccgggaagatcgccgactacaactacaagctcccggacgacttcacgggctgcgtgatcgcgtggaacagcaacaacctggactccaaggtcgggggcaactacaactacctgtaccgcctcttccgcaagagcaacctgaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctcagcttcgagctgctgcacgcccccgccacggtgtgcggccccaagaagtccaccaacctcgtcaagaacaagtgcgtgaacttcaacttcaacggcctgaccgggaccggcgtgctgaccgagagcaacaagaagttcctgccgttccagcagttcgggcgcgacatcgccgacacgaccgacgcggtccgcgacccccagaccctcgagatcctggacatcaccccctgcagcttcggcggggtgtccgtgatcacgccgggcaccaacaccagcaaccaggtcgccgtgctgtaccaggacgtgaactgcaccgaggtccccgtggccatccacgccgaccagctcacgcccacctggcgggtgtactccaccggcagcaacgtcttccagacccgcgccgggtgcctgatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctccccgtgagcatgaccaagacgagcgtcgactgcaccatgtacatctgcggggactccaccgagtgcagcaacctgctgctccagtacggctccttctgcacccagctgaaccgcgcgctgacggggatcgccgtggagcaggacaagaacacccaggaggtgttcgcccaggtcaagcagatctacaagacgcccccgatcaaggacttcggcgggttcaacttcagccagatcctccccgacccctccaagcccagcaagcggtccttcatcgaggacctgctgttcaacaaggtgaccctcgccgacgccggcttcatcaagcagtacggcgactgcctgggggacatcgcggcccgcgacctgatctgcgcccagaagttcaacggcctcaccgtgctgccgcccctgctcaccgacgagatgatcgcccagtacaccagcgccctgctggcggggaccatcacgtccggctggaccttcggggccggcgccgccctccagatccccttcgcgatgcagatggcctaccggttcaacggcatcggggtcacccagaacgtgctgtacgagaaccagaagctgatcgccaaccagttcaacagcgccatcggcaagatccaggactccctcagctccaccgccagcgcgctggggaagctgcaggacgtggtcaaccagaacgcccaggccctcaacacgctggtgaagcagctgtccagcaacttcggcgccatctccagcgtgctcaacgacatcctgtcccgcctggacaaggtcgaggccgaggtgcagatcgaccggctcatcaccgggcgcctgcagagcctgcagacctacgtgacccagcagctcatccgggcggccgagatccgcgccagcgccaacctggccgcgaccaagatgtccgagtgcgtcctgggccagagcaagcgggtggacttctgcggcaaggggtaccacctcatgtccttcccccagagcgccccgcacggcgtggtcttcctgcacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctcgactccttcaaggaggagctggacaagtacttcaagaaccacaccagccccgacgtcgacctgggggacatctccggcatcaacgccagcgtggtgaacatccagaaggagatcgaccgcctcaacgaggtcgccaagaacctgaacgagtccctgatcgacctccaggagctggggaagtacgagcagtacatcaagtggccgtggtacatctggctgggcttcatcgccggcctcatcgcgatcgtgatggtgaccatcatgctgtgctgcatgaccagctgctgctcctgcctgaaggggtgctgcagctgcggctcctgctgcaagttcgacgaggacgacagcgagcccgtcctcaagggggtgaagctgcactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12310 - RNA, 4094 nt, synthetic construct
  misc_feature 1..4094: note SARS-CoV-2/SARS-CoV-2/Yunnan-01/human/2020/CHN__MT049951.1 spike protein mRNA gc (1-1273)
  source 1..4094: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgccaacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12311 - RNA, 4094 nt, synthetic construct
  misc_feature 1..4094: note = SARS-CoV-2/USA/WA-UW292/2020__EPI_ISL_418077 spike protein mRNA gc (1-1273)
  source 1..4094: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccagctccaccccctgcaacggcgtggaggggttcaactgctacttccccctgcagagctacggcttccagccgaccaacggggtgggctaccagccctaccgggtggtcgtgctgagcttcgagctcctgcacgcccccgccacggtgtgcgggcccaagaagtccaccaacctggtcaagaacaagtgcgtgaacttcaacttcaacggcctcaccggcaccggggtgctgaccgagagcaacaagaagttcctgccgttccagcagttcggccgcgacatcgccgacacgaccgacgcggtccgcgacccccagaccctggagatcctcgacatcaccccctgctccttcgggggcgtgagcgtgatcacgccggggaccaacacctccaaccaggtcgccgtgctgtaccaggacgtgaactgcaccgaggtccccgtggccatccacgccgaccagctgacgcccacctggcgggtgtacagcaccggctccaacgtcttccagacccgcgccggctgcctcatcggggcggagcacgtgaacaacagctacgagtgcgacatccccatcggcgccgggatctgcgcctcctaccagacgcagaccaacagcccgcggcgcgcccggtccgtggcgagccagtccatcatcgcctacaccatgagcctgggcgccgagaactccgtcgcctacagcaacaactccatcgccatccccaccaacttcacgatcagcgtgaccaccgagatcctgcccgtgagcatgaccaagacgtccgtcgactgcaccatgtacatctgcggcgacagcaccgagtgctccaacctcctgctgcagtacgggagcttctgcacccagctcaaccgcgcgctgacgggcatcgccgtggagcaggacaagaacacccaggaggtgttcgcccaggtcaagcagatctacaagacgcccccgatcaaggacttcgggggcttcaacttctcccagatcctgcccgaccccagcaagccctccaagcggagcttcatcgaggacctcctgttcaacaaggtgaccctggccgacgccgggttcatcaagcagtacggcgactgcctcggcgacatcgcggcccgcgacctgatctgcgcccagaagttcaacgggctgaccgtgctcccgcccctgctgaccgacgagatgatcgcccagtacacctccgccctcctggcgggcaccatcacgagcgggtggaccttcggcgccggggccgccctgcagatccccttcgcgatgcagatggcctaccggttcaacggcatcggcgtcacccagaacgtgctctacgagaaccagaagctgatcgccaaccagttcaactccgccatcgggaagatccaggacagcctgtccagcaccgcctccgcgctcggcaagctgcaggacgtggtcaaccagaacgcccaggccctgaacacgctcgtgaagcagctgagctccaacttcggggccatcagctccgtgctgaacgacatcctcagccgcctggacaaggtcgaggccgaggtgcagatcgaccggctgatcaccggccgcctccagagcctgcagacctacgtgacccagcagctgatccgggcggccgagatccgcgcctccgccaacctcgccgcgaccaagatgagcgagtgcgtcctggggcagtccaagcgggtggacttctgcggcaagggctaccacctgatgagcttcccccagtccgccccgcacggggtggtcttcctccacgtgacgtacgtccccgcccaggagaagaacttcaccaccgcccccgcgatctgccacgacggcaaggcccacttcccccgcgagggggtgttcgtgagcaacggcacccactggttcgtcacgcagcggaacttctacgagccgcagatcatcaccaccgacaacaccttcgtgtccgggaactgcgacgtggtcatcggcatcgtgaacaacacggtgtacgaccccctgcagcccgagctggacagcttcaaggaggagctcgacaagtacttcaagaaccacacctcccccgacgtcgacctgggcgacatcagcgggatcaacgcctccgtggtgaacatccagaaggagatcgaccgcctgaacgaggtcgccaagaacctcaacgagagcctgatcgacctgcaggagctcggcaagtacgagcagtacatcaagtggccgtggtacatctggctggggttcatcgccggcctgatcgcgatcgtgatggtgaccatcatgctctgctgcatgacctcctgctgcagctgcctgaagggctgctgctcctgcgggagctgctgcaagttcgacgaggacgactccgagcccgtcctgaagggcgtgaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12312 - RNA, 4094 nt, synthetic construct
  misc_feature 1..4094: note = SARS-CoV-2/Iceland/192/2020__EPI_ISL_417819 spike protein mRNA gc (1-1273)
  source 1..4094: mol_type = other RNA
aggagagtcccgcagtcggcgtccagcggctctgcttgttcgtgtgtgtgtcgttgcaggccttattcaagcttaccatgttcgtgttcttcgtcctgctccccctggtgagctcccagtgcgtgaacctgaccacccgcacgcagctcccgcccgcctacaccaacagcttcacccggggcgtctactaccccgacaaggtgttccgctccagcgtgctgcactccacccaggacctgttcctccccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctggacagcaagacccagtccctcctgatcgtgaacaacgccaccaacgtggtcatcaaggtgtgcgagttccagttctgcaacgaccccttcctgggcgtgtactaccacaagaacaacaagagctggatggagtccgagttccgggtctacagctccgccaacaactgcacgttcgagtacgtgagccagcccttcctcatggacctggagggcaagcaggggaacttcaagaacctgcgcgagttcgtgttcaagaacatcgacggctacttcaagatctactccaagcacaccccgatcaacctcgtccgggacctgccccaggggttcagcgccctggagcccctcgtggacctgcccatcggcatcaacatcacccgcttccagaccctgctcgccctgcaccggtcctacctgacgccgggggacagcagctccggctggaccgcgggcgccgccgcctactacgtggggtacctccagccccgcaccttcctgctgaagtacaacgagaacggcaccatcacggacgcggtcgactgcgccctcgaccccctgagcgagaccaagtgcaccctgaagtccttcaccgtggagaaggggatctaccagacgagcaacttccgggtgcagcccaccgagtccatcgtccgcttcccgaacatcaccaacctctgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctgaacgacctctgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctggactccaaggtcgggggcaactacaactacctctaccgcctgttccgcaagagcaacctgaagcccttcgagcgggacatctccaccgagatctaccaggccggcagcaccccctgcaacggggtggagggcttcaactgctacttccccctccagtcctacgggttccagccgaccaacggcgtggggtaccagccctaccgggtggtcgtgctgagcttcgagctgctccacgcccccgccacggtgtgcggccccaagaagtccaccaacctggtcaagaacaagtgcgtgaacttcaacttcaacggcctgaccgggaccggcgtgctcaccgagagcaacaagaagttcctgccgttccagcagttcgggcgcgacatcgccgacacgaccgacgcggtccgcgacccccagaccctggagatcctggacatcaccccctgcagcttcggcggggtgtccgtgatcacgccgggcaccaacaccagcaaccaggtcgccgtgctctaccagggcgtgaactgcaccgaggtccccgtggccatccacgccgaccagctgacgcccacctggcgggtgtactccaccgggagcaacgtcttccagacccgcgccggctgcctgatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctcggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctgctcctgcagtacgggtccttctgcacccagctgaaccgcgcgctcacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctgggcgacatcgcggcccgcgacctcatctgcgcccagaagttcaacgggctgaccgtgctgccgcccctcctgaccgacgagatgatcgcccagtacaccagcgccctgctcgcgggcaccatcacgtccgggtggaccttcggcgccggcgccgccctgcagatccccttcgcgatgcagatggcctaccggttcaacgggatcggcgtcacccagaacgtgctgtacgagaaccagaagctcatcgccaaccagttcaacagcgccatcgggaagatccaggactccctgagctccaccgccagcgcgctgggcaagctccaggacgtggtcaaccagaacgcccaggccctgaacacgctggtgaagcagctctccagcaacttcggggccatctccagcgtgctgaacgacatcctgtcccgcctcgacaaggtcgaggccgaggtgcagatcgaccggctgatcaccggccgcctgcagagcctccagacctacgtgacccagcagctgatccgggcggccgagatccgcgccagcgccaacctggccgcgaccaagatgtccgagtgcgtcctcggccagagcaagcgggtggacttctgcgggaagggctaccacctgatgtccttcccccagagcgccccgcacggggtggtcttcctgcacgtgacgtacgtccccgcccaggagaagaacttcaccaccgcccccgcgatctgccacgacggcaaggcccacttcccccgcgagggggtgttcgtgtccaacggcacccactggttcgtcacgcagcggaacttctacgagccgcagatcatcaccaccgacaacaccttcgtgagcggcaactgcgacgtggtcatcgggatcgtgaacaacacggtgtacgaccccctccagcccgagctggactccttcaaggaggagctggacaagtacttcaagaaccacaccagccccgacgtcgacctcggcgacatctccgggatcaacgccagcgtggtgaacatccagaaggagatcgaccgcctgaacgaggtcgccaagaacctgaacgagtccctcatcgacctgcaggagctgggcaagtacgagcagtacatcaagtggccgtggtacatctggctcggcttcatcgccgggctgatcgcgatcgtgatggtgaccatcatgctgtgctgcatgaccagctgctgctcctgcctcaagggctgctgcagctgcgggtcctgctgcaagttcgacgaggacgacagcgagcccgtcctgaagggcgtgaagctgcactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12313 - RNA, 4094 nt, synthetic construct
  misc_feature 1..4094: note = SARS-CoV-2/Belgium/ULG-6939/2020__EPI_ISL_417020 spike protein mRNA gc (1-1273)
  source 1..4094: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgtgtactccaacaacagcatcgccatccccaccaacttcacgatctccgtgaccaccgagatcctgcccgtcagcatgaccaagacgagcgtggactgcaccatgtacatctgcggcgactccaccgagtgcagcaacctcctgctgcagtacgggtccttctgcacccagctcaaccgcgccctgacgggcatcgcggtggagcaggacaagaacacccaggaggtcttcgcccaggtgaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgccgcgcgcgacctgatctgcgcccagaagttcaacgggctgaccgtcctcccgcccctgctgaccgacgagatgatcgcccagtacaccagcgccctcctggccggcaccatcacgtccgggtggaccttcggcgcgggcgccgccctgcagatccccttcgccatgcagatggcgtaccggttcaacgggatcggcgtgacccagaacgtgctctacgagaaccagaagctgatcgccaaccagttcaacagcgccatcgggaagatccaggactccctgagctccaccgccagcgccctcggcaagctgcaggacgtcgtgaaccagaacgcgcaggccctgaacacgctcgtgaagcagctgtccagcaacttcggggccatctccagcgtcctgaacgacatcctctcccgcctggacaaggtggaggccgaggtgcagatcgaccggctgatcaccggccgcctccagagcctgcagacctacgtcacccagcagctgatccgggccgcggagatccgcgccagcgccaacctcgccgccaccaagatgtccgagtgcgtgctgggccagagcaagcgggtggacttctgcgggaagggctaccacctgatgtccttcccccagagcgcgccgcacggggtcgtgttcctccacgtcacgtacgtgcccgcccaggagaagaacttcaccaccgcccccgccatctgccacgacggcaaggcgcacttcccccgcgagggggtgttcgtctccaacggcacccactggttcgtgacgcagcggaacttctacgagccgcagatcatcaccaccgacaacaccttcgtgagcggcaactgcgacgtcgtgatcgggatcgtgaacaacacggtctacgaccccctgcagcccgagctggactccttcaaggaggagctcgacaagtacttcaagaaccacaccagccccgacgtggacctgggcgacatctccgggatcaacgccagcgtggtcaacatccagaaggagatcgaccgcctgaacgaggtggccaagaacctcaacgagtccctgatcgacctgcaggagctcggcaagtacgagcagtacatcaagtggccgtggtacatctggctgggcttcatcgccgggctgatcgccatcgtgatggtcaccatcatgctctgctgcatgaccagctgctgctcctgcctgaagggctgctgcagctgcgggtcctgctgcaagttcgacgaggacgacagcgagcccgtgctgaagggcgtgaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12314 - RNA, 4094 nt, synthetic construct
  misc_feature 1..4094: note = SARS-CoV-2/France/HF2496/2020__EPI_ISL_418231 spike protein mRNA gc (1-1273)
  source 1..4094: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgtggcgcgcgacctgatctgcgcccagaagttcaacgggctgaccgtcctcccgcccctgctgaccgacgagatgatcgcccagtacaccagcgccctcctggccggcaccatcacgtccgggtggaccttcggcgcgggcgccgccctgcagatccccttcgccatgcagatggcgtaccggttcaacgggatcggcgtgacccagaacgtgctctacgagaaccagaagctgatcgccaaccagttcaacagcgccatcgggaagatccaggactccctgagctccaccgccagcgccctcggcaagctgcaggacgtcgtgaaccagaacgcgcaggccctgaacacgctcgtgaagcagctgtccagcaacttcggggccatctccagcgtcctgaacgacatcctctcccgcctggacaaggtggaggccgaggtgcagatcgaccggctgatcaccggccgcctccagagcctgcagacctacgtcacccagcagctgatccgggccgcggagatccgcgccagcgccaacctcgccgccaccaagatgtccgagtgcgtgctgggccagagcaagcgggtggacttctgcgggaagggctaccacctgatgtccttcccccagagcgcgccgcacggggtcgtgttcctccacgtcacgtacgtgcccgcccaggagaagaacttcaccaccgcccccgccatctgccacgacggcaaggcgcacttcccccgcgagggggtgttcgtctccaacggcacccactggttcgtgacgcagcggaacttctacgagccgcagatcatcaccaccgacaacaccttcgtgagcggcaactgcgacgtcgtgatcgggatcgtgaacaacacggtctacgaccccctgcagcccgagctggactccttcaaggaggagctcgacaagtacttcaagaaccacaccagccccgacgtggacctgggcgacatctccgggatcaacgccagcgtggtcaacatccagaaggagatcgaccgcctgaacgaggtggccaagaacctcaacgagtccctgatcgacctgcaggagctcggcaagtacgagcagtacatcaagtggccgtggtacatctggctgggcttcatcgccgggctgatcgccatcgtgatggtcaccatcatgctctgctgcatgaccagctgctgctcctgcctgaagggctgctgcagctgcgggtcctgctgcaagttcgacgaggacgacagcgagcccgtgctgaagggcgtgaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12315 - RNA, 4094 nt, synthetic construct
  misc_feature 1..4094: note = SARS-CoV-2/USA/WA-UW291/2020__EPI_ISL_418076 spike protein mRNA gc (1-1273)
  source 1..4094: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccagtactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacaaggtcgaggccgaggtgcagatcgaccggctgatcaccggccgcctccagagcctgcagacctacgtgacccagcagctgatccgggcggccgagatccgcgccagcgccaacctcgccgcgaccaagatgtccgagtgcgtcctgggccagagcaagcgggtggacttctgcgggaagggctaccacctgatgtccttcccccagagcgccccgcacggggtggtcttcctccacgtgacgtacgtccccgcccaggagaagaacttcaccaccgcccccgcgatctgccacgacggcaaggcccacttcccccgcgagggggtgttcgtgtccaacggcacccactggttcgtcacgcagcggaacttctacgagccgcagatcatcaccaccgacaacaccttcgtgagcggcaactgcgacgtggtcatcgggatcgtgaacaacacggtgtacgaccccctgcagcccgagctggactccttcaaggaggagctcgacaagtacttcaagaaccacaccagccccgacgtcgacctgggcgacatctccgggatcaacgccagcgtggtgaacatccagaaggagatcgaccgcctgaacgaggtcgccaagaacctcaacgagtccctgatcgacctgcaggagctcggcaagtacgagcagtacatcaagtggccgtggtacatctggctgggcttcatcgccgggctgatcgcgatcgtgatggtgaccatcatgctctgctgcatgaccagctgctgctcctgcctgaagggctgctgcagctgcgggtcctgctgcaagttcgacgaggacgacagcgagcccgtcctgaagggcgtgaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12316 - RNA, 4094 nt, synthetic construct
  misc_feature 1..4094: note = SARS-CoV-2/Portugal/PT0034/2020__EPI_ISL_418019 spike protein mRNA gc (1-1273)
  source 1..4094: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacaaggtcgaggccgaggtgcagatcgaccggctgatcaccggccgcctccagagcctgcagacctacgtgacccagcagctgatccgggcggccgagatccgcgccagcgccaacctcgccgcgaccaagatgtccgagtgcgtcctgggccagagcaagcgggtggacttctgcgggaagggctaccacctgatgtccttcccccagagcgccccgcacggggtggtcttcctccacgtgacgtacgtccccgcccaggagaagaacttcaccaccgcccccgcgatctgccacgacggcaaggcccacttcccccgcgagggggtgttcgtgtccaacggcacccactggttcgtcacgcagcggaacttctacgagccgcagatcatcaccaccgacaacaccttcgtgagcggcaactgcgacgtggtcatcgggatcgtgaacaacacggtgtacgaccccctgcagcccgagctggactccttcaaggaggagctcgacaagtacttcaagaaccacaccagccccgacgtcgacctgggcgacatctccgggatcaacgccagcgtggtgaacatccagaaggagatcgaccgcctgaacgaggtcgccaagaacctcaacgagtccctgatcgacctgcaggagctcggcaagtacgagcagtacatcaagtggccgtggtacatctggctgggcttcatcgccgggctgatcgcgatcgtgatggtgaccatcatgctctgctgcatcaccagctgctgctcctgcctgaagggctgctgcagctgcgggtcctgctgcaagttcgacgaggacgacagcgagcccgtcctgaagggcgtgaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12317 - RNA, 4094 nt, synthetic construct
  misc_feature 1..4094: note = SARS-CoV-2/Iceland/202/2020__EPI_ISL_417750 spike protein mRNA gc (1-1273)
  source 1..4094: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatcccgggcatcaacgcctccgtggtgaacatccagaaggagatcgaccgcctgaacgaggtcgccaagaacctcaacgagagcctgatcgacctgcaggagctcgggaagtacgagcagtacatcaagtggccctggtacatctggctgggcttcatcgccggcctgatcgcgatcgtgatggtgaccatcatgctctgctgcatgacctcctgctgcagctgcctgaaggggtgctgctcctgcggcagctgctgcaagttcgacgaggacgactccgagcccgtcctgaagggggtgaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12318 - RNA, 4094 nt, synthetic construct
  misc_feature 1..4094: note = SARS-CoV-2/USA/WA-UW261/2020__EPI_ISL_418046 spike protein mRNA gc (1-1273)
  source 1..4094: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcacgagcgtctacgcctggaaccgcaagcggatctccaactgcgtggccgactacagcgtgctgtacaactccgcgagcttctccaccttcaagtgctacggcgtcagccccaccaagctcaacgacctgtgcttcaccaacgtgtacgccgactccttcgtgatccgcggggacgaggtccggcagatcgcccccggccagacggggaagatcgccgactacaactacaagctgccggacgacttcaccggctgcgtgatcgcctggaacagcaacaacctcgactccaaggtcgggggcaactacaactacctgtaccgcctgttccgcaagagcaacctcaagcccttcgagcgggacatctccaccgagatctaccaggcgggcagcaccccctgcaacggggtggagggcttcaactgctacttccccctgcagtcctacgggttccagccgacgaacggcgtggggtaccagccctaccgggtggtcgtgctgagcttcgagctcctgcacgcccccgccaccgtgtgcggccccaagaagtccaccaacctggtcaagaacaagtgcgtgaacttcaacttcaacggcctcaccgggaccggcgtgctgacggagagcaacaagaagttcctgccgttccagcagttcgggcgcgacatcgccgacaccaccgacgccgtccgcgacccccagaccctggagatcctcgacatcacgccctgcagcttcggcggggtgtccgtgatcaccccgggcaccaacaccagcaaccaggtcgcggtgctgtaccaggacgtgaactgcacggaggtccccgtggccatccacgccgaccagctgacccccacctggcgggtgtactccaccggcagcaacgtcttccagacgcgcgccgggtgcctcatcggcgccgagcacgtgaacaactcctacgagtgcgacatccccatcggggcgggcatctgcgccagctaccagacccagaccaactccccgcggcgcgcccggagcgtggcctcccagagcatcatcgcgtacaccatgtccctgggcgccgagaacagcgtcgcctactccaacaacagcatcgccatccccacgaacttcaccatctccgtgaccaccgagatcctgcccgtgagcatgacgaagaccagcgtcgactgcaccatgtacatctgcggggactccaccgagtgcagcaacctcctgctgcagtacggctccttctgcacgcagctcaaccgcgccctgaccgggatcgcggtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgccgcgcgcgacctgatctgcgcccagaagttcaacggcctgaccgtgctcccgcccctgctgaccgacgagatgatcgcccagtacaccagcgccctcctggccgggacgatcacctccggctggaccttcggggcgggcgccgccctgcagatccccttcgccatgcagatggcgtaccggttcaacggcatcggggtcacccagaacgtgctctacgagaaccagaagctgatcgccaaccagttcaacagcgccatcggcaagatccaggactccctgagctccacggccagcgccctcgggaagctgcaggacgtggtcaaccagaacgcgcaggccctgaacaccctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggccgcggagatccgcgccagcgccaacctcgccgccacgaagatgtccgagtgcgtcctgggccagagcaagcgggtggacttctgcggcaaggggtaccacctgatgtccttcccccagagcgcgccgcacggcgtggtcttcctccacgtgacctacgtccccgcccaggagaagaacttcaccaccgcccccgccatctgccacgacgggaaggcgcacttcccccgcgagggcgtgttcgtgtccaacgggacgcactggttcgtcacccagcggaacttctacgagccgcagatcatcaccaccgacaacacgttcgtgagcggcaactgcgacgtggtcatcggcatcgtgaacaacaccgtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgccatcgtgatggtgaccatcatgctctgctgcatgacgagctgctgctcctgcctgaaggggtgctgcagctgcggctcctgctgcaagttcgacgaggacgacagcgagcccgtcctgaagggggtgaagctccactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12319 - RNA, 4094 nt, synthetic construct
  misc_feature 1..4094: note = SARS-CoV-2/Portugal/PT0035/2020__EPI_ISL_418020 spike protein mRNA gc (1-1273)
  source 1..4094: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcagcgcgcgcgacctgatctgcgcccagaagttcaacggcctgaccgtgctcccgcccctgctgaccgacgagatgatcgcccagtacacctccgccctcctggccgggaccatcacgagcggctggaccttcggggcgggcgccgccctgcagatccccttcgccatgcagatggcgtaccggttcaacggcatcggggtcacccagaacgtgctctacgagaaccagaagctgatcgccaaccagttcaactccgccatcggcaagatccaggacagcctgtccagcaccgcctccgccctcgggaagctgcaggacgtggtcaaccagaacgcgcaggccctgaacacgctcgtgaagcagctgagctccaacttcggcgccatcagctccgtgctgaacgacatcctcagccgcctggacaaggtcgaggccgaggtgcagatcgaccggctgatcaccgggcgcctccagagcctgcagacctacgtgacccagcagctgatccgggccgcggagatccgcgcctccgccaacctcgccgccaccaagatgagcgagtgcgtcctgggccagtccaagcgggtggacttctgcggcaaggggtaccacctgatgagcttcccccagtccgcgccgcacggcgtggtcttcctccacgtgacgtacgtccccgcccaggagaagaacttcaccaccgcccccgccatctgccacgacgggaaggcgcacttcccccgcgagggcgtgttcgtgagcaacgggacccactggttcgtcacgcagcggaacttctacgagccgcagatcatcaccaccgacaacaccttcgtgtccggcaactgcgacgtggtcatcggcatcgtgaacaacacggtgtacgaccccctgcagcccgagctggacagcttcaaggaggagctcgacaagtacttcaagaaccacacctcccccgacgtcgacctgggggacatcagcggcatcaacgcctccgtggtgaacatccagaaggagatcgaccgcctgaacgaggtcgccaagaacctcaacgagagcctgatcgacctgcaggagctcgggaagtacgagcagtacatcaagtggccgtggtacatctggctgggcttcatcgccggcctgatcgccatcgtgatggtgaccatcatgctctgctgcatgacctcctgctgcagctgcctgaaggggtgctgctcctgcggcagctgctgcaagttcgacgaggacgactccgagcccgtcctgaagggggtgaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12320 - RNA, 4094 nt, synthetic construct
  misc_feature 1..4094: note = SARS-CoV-2/USA/NY-NYUMC7/2020__EPI_ISL_418192 spike protein mRNA gc (1-1273)
  source 1..4094: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtaccaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacaaggtcgaggccgaggtgcagatcgaccggctgatcaccggccgcctccagagcctgcagacctacgtgacccagcagctgatccgggcggccgagatccgcgccagcgccaacctcgccgcgaccaagatgtccgagtgcgtcctgggccagagcaagcgggtggacttctgcgggaagggctaccacctgatgtccttcccccagagcgccccgcacggggtggtcttcctccacgtgacgtacgtccccgcccaggagaagaacttcaccaccgcccccgcgatctgccacgacggcaaggcccacttcccccgcgagggggtgttcgtgtccaacggcacccactggttcgtcacgcagcggaacttctacgagccgcagatcatcaccaccgacaacaccttcgtgagcggcaactgcgacgtggtcatcgggatcgtgaacaacacggtgtacgaccccctgcagcccgagctggactccttcaaggaggagctcgacaagtacttcaagaaccacaccagccccgacgtcgacctgggcgacatctccgggatcaacgccagcgtggtgaacatccagaaggagatcgaccgcctgaacgaggtcgccaagaacctcaacgagtccctgatcgacctgcaggagctcggcaagtacgagcagtacatcaagtggccgtggtacatctggctgggcttcatcgccgggctgatcgcgatcgtgatggtgaccatcatgctctgctgcatgaccagctgctgctcctgcctgaagggctgctgcagctgcgggtcctgctgcaagttcgacgaggacgacagcgagcccgtcctgaagggcgtgaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12321 - RNA, 4094 nt, synthetic construct
  misc_feature 1..4094: note = SARS-CoV-2/Iceland/189/2020__EPI_ISL_417709 spike protein mRNA gc (1-1273)
  source 1..4094: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcaccaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcacgatcacctccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccacggccagcgcgctcggcaagctgcaggacgtggtcaaccagaacgcccaggccctgaacaccctcgtgaagcagctgtccagcaacttcggggccatctccagcgtgctgaacgacatcctctcccgcctggacaaggtcgaggccgaggtgcagatcgaccggctgatcaccggccgcctccagagcctgcagacctacgtgacccagcagctgatccgggcggccgagatccgcgccagcgccaacctcgccgcgacgaagatgtccgagtgcgtcctgggccagagcaagcgggtggacttctgcgggaagggctaccacctgatgtccttcccccagagcgccccgcacggggtggtcttcctccacgtgacctacgtccccgcccaggagaagaacttcaccaccgcccccgcgatctgccacgacggcaaggcccacttcccccgcgagggggtgttcgtgtccaacggcacgcactggttcgtcacccagcggaacttctacgagccgcagatcatcaccaccgacaacacgttcgtgagcggcaactgcgacgtggtcatcgggatcgtgaacaacaccgtgtacgaccccctgcagcccgagctggactccttcaaggaggagctcgacaagtacttcaagaaccacaccagccccgacgtcgacctgggcgacatctccgggatcaacgccagcgtggtgaacatccagaaggagatcgaccgcctgaacgaggtcgccaagaacctcaacgagtccctgatcgacctgcaggagctcggcaagtacgagcagtacatcaagtggccgtggtacatctggctgggcttcatcgccgggctgatcgcgatcgtgatggtgaccatcatgctctgctgcatgacgagctgctgctcctgcctgaagggctgctgcagctgcgggtcctgctgcaagttcgacgaggacgacagcgagcccgtcctgaagggcgtgaagctccactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12322 - RNA, 4094 nt, synthetic construct
  misc_feature 1..4094: note = SARS-CoV-2/Australia/NSW56/2020__EPI_ISL_417408 spike protein mRNA gc (1-1273)
  source 1..4094: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgactccagcaagccctccaagcggagcttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctgcccccgctcctgaccgacgagatgatcgcccagtacacctccgccctcctggcggggaccatcacgagcggctggaccttcggggccggcgccgccctgcagatccccttcgcgatgcagatggcctaccggttcaacggcatcggggtcacccagaacgtgctctacgagaaccagaagctgatcgccaaccagttcaactccgccatcggcaagatccaggacagcctgtccagcaccgcctccgcgctcgggaagctgcaggacgtggtcaaccagaacgcccaggccctgaacacgctcgtgaagcagctgagctccaacttcggcgccatcagctccgtgctgaacgacatcctcagccgcctggacaaggtcgaggccgaggtgcagatcgaccggctgatcaccgggcgcctccagagcctgcagacctacgtgacccagcagctgatccgggcggccgagatccgcgcctccgccaacctcgccgcgaccaagatgagcgagtgcgtcctgggccagtccaagcgggtggacttctgcggcaaggggtaccacctgatgagcttcccccagtccgcgccccacggcgtggtcttcctccacgtgacgtacgtcccggcccaggagaagaacttcaccaccgcccccgccatctgccacgacgggaaggcccacttcccccgcgagggcgtgttcgtgagcaacgggacccactggttcgtcacgcagcggaacttctacgagccccagatcatcaccaccgacaacaccttcgtgtccggcaactgcgacgtggtcatcggcatcgtgaacaacacggtgtacgacccgctgcagcccgagctggacagcttcaaggaggagctcgacaagtacttcaagaaccacacctcccccgacgtcgacctgggggacatcagcggcatcaacgcctccgtggtgaacatccagaaggagatcgaccgcctgaacgaggtcgccaagaacctcaacgagagcctgatcgacctgcaggagctcgggaagtacgagcagtacatcaagtggccctggtacatctggctgggcttcatcgccggcctgatcgcgatcgtgatggtgaccatcatgctctgctgcatgacctcctgctgcagctgcctgaaggggtgctgctcctgcggcagctgctgcaagttcgacgaggacgactccgagccggtcctgaagggggtgaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12323 - RNA, 4094 nt, synthetic construct
  misc_feature 1..4094: note = SARS-CoV-2/Iceland/280/2020__EPI_ISL_417608 spike protein mRNA gc (1-1273)
  source 1..4094: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccacacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacaaggtcgaggccgaggtgcagatcgaccggctgatcaccggccgcctccagagcctgcagacctacgtgacccagcagctgatccgggcggccgagatccgcgccagcgccaacctcgccgcgaccaagatgtccgagtgcgtcctgggccagagcaagcgggtggacttctgcgggaagggctaccacctgatgtccttcccccagagcgccccgcacggggtggtcttcctccacgtgacgtacgtccccgcccaggagaagaacttcaccaccgcccccgcgatctgccacgacggcaaggcccacttcccccgcgagggggtgttcgtgtccaacggcacccactggttcgtcacgcagcggaacttctacgagccgcagatcatcaccaccgacaacaccttcgtgagcggcaactgcgacgtggtcatcgggatcgtgaacaacacggtgtacgaccccctgcagcccgagctggactccttcaaggaggagctcgacaagtacttcaagaaccacaccagccccgacgtcgacctgggcgacatctccgggatcaacgccagcgtggtgaacatccagaaggagatcgaccgcctgaacgaggtcgccaagaacctcaacgagtccctgatcgacctgcaggagctcggcaagtacgagcagtacatcaagtggccgtggtacatctggctgggcttcatcgccgggctgatcgcgatcgtgatggtgaccatcatgctctgctgcatgaccagctgctgctcctgcctgaagggctgctgcagctgcgggtcctgctgcaagttcgacgaggacgacagcgagcccgtcctgaagggcgtgaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12324 - RNA, 4094 nt, synthetic construct
  misc_feature 1..4094: note = SARS-CoV-2/Iceland/247/2020__EPI_ISL_417575 spike protein mRNA gc (1-1273)
  source 1..4094: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacaaggtcgaggccgaggtgcagatcgaccggctgatcaccggccgcctccagagcctgcagacctacgtgacccagcagctgatccgggcggccgagatccgcgccagcgccaacctcgccgcgaccaagatgtccgagtgcgtcctgggccagagcaagcgggtggacttctgcgggaagggctaccacctgatgtccttcccccagagcgccccgcacggggtggtcttcctccacgtgacgtacgtccccgcccaggagaagaacttcaccaccgcccccgcgatctgccacgacggcaaggcccacttcccccgcgagggggtgttcgtgtccaacggcacccactggttcgtcacgcagcggaacttctacgagccgcagatcatcaccaccgacaacaccttcgtgagcggcaactgcgacgtggtcatcgggatcgtgaacaacacggtgtacgaccccctgcagcccgagctggactccttcaaggaggagctcgacaagtacttcaagaaccacaccagccccgacgtcgacctgggcgacatctccgggatcaacgccagcgtggtgaacatccagaaggagatcgaccgcctgaacgaggtcgccaagaacctcaacgagtccctgatcgacctgcaggagctcggcaagtacgagcagtacatcaagtggccgtggtacatctggctgggcttcatcgccgggctgatcgcgatcgtgatcgtgaccatcatgctctgctgcatgaccagctgctgctcctgcctgaagggctgctgcagctgcgggtcctgctgcaagttcgacgaggacgacagcgagcccgtcctgaagggcgtgaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12325 - RNA, 4094 nt, synthetic construct
  misc_feature 1..4094: note = SARS-CoV-2/Iceland/238/2020__EPI_ISL_417566 spike protein mRNA gc (1-1273)
  source 1..4094: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgtgggcttcatcaagcagtacggggactgcctcggcgacatcgccgcgcgcgacctgatctgcgcccagaagttcaacgggctgaccgtcctcccgcccctgctgaccgacgagatgatcgcccagtacaccagcgccctcctggccggcaccatcacgtccgggtggaccttcggcgcgggcgccgccctgcagatccccttcgccatgcagatggcgtaccggttcaacgggatcggcgtgacccagaacgtgctctacgagaaccagaagctgatcgccaaccagttcaacagcgccatcgggaagatccaggactccctgagctccaccgccagcgccctcggcaagctgcaggacgtcgtgaaccagaacgcgcaggccctgaacacgctcgtgaagcagctgtccagcaacttcggggccatctccagcgtcctgaacgacatcctctcccgcctggacaaggtggaggccgaggtgcagatcgaccggctgatcaccggccgcctccagagcctgcagacctacgtcacccagcagctgatccgggccgcggagatccgcgccagcgccaacctcgccgccaccaagatgtccgagtgcgtgctgggccagagcaagcgggtggacttctgcgggaagggctaccacctgatgtccttcccccagagcgcgccgcacggggtcgtgttcctccacgtcacgtacgtgcccgcccaggagaagaacttcaccaccgcccccgccatctgccacgacggcaaggcgcacttcccccgcgagggggtgttcgtctccaacggcacccactggttcgtgacgcagcggaacttctacgagccgcagatcatcaccaccgacaacaccttcgtgagcggcaactgcgacgtcgtgatcgggatcgtgaacaacacggtctacgaccccctgcagcccgagctggactccttcaaggaggagctcgacaagtacttcaagaaccacaccagccccgacgtggacctgggcgacatctccgggatcaacgccagcgtggtcaacatccagaaggagatcgaccgcctgaacgaggtggccaagaacctcaacgagtccctgatcgacctgcaggagctcggcaagtacgagcagtacatcaagtggccgtggtacatctggctgggcttcatcgccgggctgatcgccatcgtgatggtcaccatcatgctctgctgcatgaccagctgctgctcctgcctgaagggctgctgcagctgcgggtcctgctgcaagttcgacgaggacgacagcgagcccgtgctgaagggcgtgaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12326 - RNA, 4094 nt, synthetic construct
  misc_feature 1..4094: note = SARS-CoV-2/Greece/16/2020__EPI_ISL_418265 spike protein mRNA gc (1-1273)
  source 1..4094: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacgtcgacggctacttcaagatctactccaagcacaccccgatcaacctggtgcgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtcgggtacctgcagccccgcaccttcctgctcaagtacaacgagaacggcaccatcacggacgcggtggactgcgccctggaccccctgagcgagaccaagtgcaccctcaagtccttcaccgtggagaaggggatctaccagacgagcaacttccgggtccagcccaccgagtccatcgtgcgcttcccgaacatcaccaacctgtgccccttcggcgaggtcttcaacgccacccggttcgccagcgtgtacgcctggaaccgcaagcggatctccaactgcgtggcggactacagcgtcctgtacaactccgccagcttctccacgttcaagtgctacggcgtgagccccaccaagctcaacgacctgtgcttcaccaacgtgtacgccgactccttcgtcatccgcggggacgaggtgcggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtcgtggtgctgagcttcgagctcctgcacgcccccgccacggtctgcggccccaagaagtccaccaacctggtgaagaacaagtgcgtgaacttcaacttcaacggcctcaccgggaccggcgtcctgaccgagagcaacaagaagttcctgccgttccagcagttcgggcgcgacatcgccgacacgaccgacgcggtgcgcgacccccagaccctggagatcctcgacatcaccccctgcagcttcggcggggtgtccgtcatcacgccgggcaccaacaccagcaaccaggtggccgtgctgtaccaggacgtcaactgcaccgaggtgcccgtggccatccacgccgaccagctgacgcccacctggcgggtctactccaccggcagcaacgtgttccagacccgcgccgggtgcctcatcggcgcggagcacgtgaacaactcctacgagtgcgacatccccatcggggccggcatctgcgccagctaccagacgcagaccaactccccgcggcgcgcccggagcgtcgcgtcccagagcatcatcgcctacaccatgtccctgggcgccgagaacagcgtggcctactccaacaacagcatcgccatccccaccaacttcacgatctccgtgaccaccgagatcctgcccgtcagcatgaccaagacgagcgtggactgcaccatgtacatctgcggggactccaccgagtgcagcaacctcctgctgcagtacggctccttctgcacccagctcaaccgcgcgctgacggggatcgccgtggagcaggacaagaacacccaggaggtcttcgcccaggtgaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtcctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtgacccagaacgtgctctacgagaaccagaagctgatcgccaaccagttcaacagcgccatcggcaagatccaggactccctgagctccaccgccagcgcgctcgggaagctgcaggacgtcgtgaaccagaacgcccaggccctgaacacgctcgtgaagcagctgtccagcaacttcggcgccatctccagcgtcctgaacgacatcctctcccgcctggacaaggtggaggccgaggtgcagatcgaccggctgatcaccgggcgcctccagagcctgcagacctacgtcacccagcagctgatccgggcggccgagatccgcgccagcgccaacctcgccgcgaccaagatgtccgagtgcgtgctgggccagagcaagcgggtggacttctgcggcaaggggtaccacctgatgtccttcccccagagcgccccgcacggcgtcgtgttcctccacgtcacgtacgtgcccgcccaggagaagaacttcaccaccgcccccgcgatctgccacgacgggaaggcccacttcccccgcgagggcgtgttcgtctccaacgggacccactggttcgtgacgcagcggaacttctacgagccgcagatcatcaccaccgacaacaccttcgtgagcggcaactgcgacgtcgtgatcggcatcgtgaacaacacggtctacgaccccctgcagcccgagctggactccttcaaggaggagctcgacaagtacttcaagaaccacaccagccccgacgtggacctgggggacatctccggcatcaacgccagcgtggtcaacatccagaaggagatcgaccgcctgaacgaggtggccaagaacctcaacgagtccctgatcgacctgcaggagctcgggaagtacgagcagtacatcaagtggccgtggtacatctggctgggcttcatcgccggcctgatcgcgatcgtgatggtcaccatcatgctctgctgcatgaccagctgctgctcctgcctgaaggggtgctgcagctgcggctcctgctgcaagttcgacgaggacgacagcgagcccgtgctgaagggggtgaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12327 - RNA, 4094 nt, synthetic construct
  misc_feature 1..4094: note = SARS-CoV-2/Iceland/319/2020__EPI_ISL_417648 spike protein mRNA gc (1-1273)
  source 1..4094: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatcgacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacaaggtcgaggccgaggtgcagatcgaccggctgatcaccggccgcctccagagcctgcagacctacgtgacccagcagctgatccgggcggccgagatccgcgccagcgccaacctcgccgcgaccaagatgtccgagtgcgtcctgggccagagcaagcgggtggacttctgcgggaagggctaccacctgatgtccttcccccagagcgccccgcacggggtggtcttcctccacgtgacgtacgtccccgcccaggagaagaacttcaccaccgcccccgcgatctgccacgacggcaaggcccacttcccccgcgagggggtgttcgtgtccaacggcacccactggttcgtcacgcagcggaacttctacgagccgcagatcatcaccaccgacaacaccttcgtgagcggcaactgcgacgtggtcatcgggatcgtgaacaacacggtgtacgaccccctgcagcccgagctggactccttcaaggaggagctcgacaagtacttcaagaaccacaccagccccgacgtcgacctgggcgacatctccgggatcaacgccagcgtggtgaacatccagaaggagatcgaccgcctgaacgaggtcgccaagaacctcaacgagtccctgatcgacctgcaggagctcggcaagtacgagcagtacatcaagtggccgtggtacatctggctgggcttcatcgccgggctgatcgcgatcgtgatggtgaccatcatgctctgctgcatgaccagctgctgctcctgcctgaagggctgctgcagctgcgggtcctgctgcaagttcgacgaggacgacagcgagcccgtcctgaagggcgtgaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12328 - RNA, 4094 nt, synthetic construct
  misc_feature 1..4094: note = SARS-CoV-2/Congo/94/2020__EPI_ISL_417947 spike protein mRNA gc (1-1273)
  source 1..4094: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacatcctcttcaacaaggtgaccctggccgacgccggcttcatcaagcagtacggggactgcctgggcgacatcgcggcccgcgacctcatctgcgcccagaagttcaacgggctgaccgtgctgccgcccctcctgaccgacgagatgatcgcccagtacaccagcgccctgctcgcgggcaccatcacgtccgggtggaccttcggcgccggcgccgccctgcagatccccttcgcgatgcagatggcctaccggttcaacgggatcggcgtcacccagaacgtgctgtacgagaaccagaagctcatcgccaaccagttcaacagcgccatcgggaagatccaggactccctgagctccaccgccagcgcgctgggcaagctccaggacgtggtcaaccagaacgcccaggccctgaacacgctggtgaagcagctctccagcaacttcggggccatctccagcgtgctgaacgacatcctgtcccgcctcgacaaggtcgaggccgaggtgcagatcgaccggctgatcaccggccgcctgcagagcctccagacctacgtgacccagcagctgatccgggcggccgagatccgcgccagcgccaacctggccgcgaccaagatgtccgagtgcgtcctcggccagagcaagcgggtggacttctgcgggaagggctaccacctgatgtccttcccccagagcgccccgcacggggtggtcttcctgcacgtgacgtacgtccccgcccaggagaagaacttcaccaccgcccccgcgatctgccacgacggcaaggcccacttcccccgcgagggggtgttcgtgtccaacggcacccactggttcgtcacgcagcggaacttctacgagccgcagatcatcaccaccgacaacaccttcgtgagcggcaactgcgacgtggtcatcgggatcgtgaacaacacggtgtacgaccccctccagcccgagctggactccttcaaggaggagctggacaagtacttcaagaaccacaccagccccgacgtcgacctcggcgacatctccgggatcaacgccagcgtggtgaacatccagaaggagatcgaccgcctgaacgaggtcgccaagaacctgaacgagtccctcatcgacctgcaggagctgggcaagtacgagcagtacatcaagtggccgtggtacatctggctcggcttcatcgccgggctgatcgcgatcgtgatggtgaccatcatgctgtgctgcatgaccagctgctgctcctgcctcaagggctgctgcagctgcgggtcctgctgcaagttcgacgaggacgacagcgagcccgtcctgaagggcgtgaagctgcactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12329 - RNA, 4094 nt, synthetic construct
  misc_feature 1..4094: note = SARS-CoV-2/Congo/158/2020__EPI_ISL_417950 spike protein mRNA gc (1-1273)
  source 1..4094: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcctgagcggcaactgcgacgtggtgatcggcatcgtcaacaacacggtgtacgaccccctgcagcccgagctcgactccttcaaggaggagctggacaagtacttcaagaaccacaccagccccgacgtggacctgggggacatctccggcatcaacgccagcgtcgtgaacatccagaaggagatcgaccgcctcaacgaggtggccaagaacctgaacgagtccctgatcgacctccaggagctggggaagtacgagcagtacatcaagtggccgtggtacatctggctgggcttcatcgccggcctcatcgcgatcgtcatggtgaccatcatgctgtgctgcatgaccagctgctgctcctgcctgaaggggtgctgcagctgcggctcctgctgcaagttcgacgaggacgacagcgagcccgtgctcaagggggtcaagctgcactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12330 - RNA, 4094 nt, synthetic construct
  misc_feature 1..4094: note = SARS-CoV-2/USA/UT-00034/2020__EPI_ISL_417977 spike protein mRNA gc (1-1273)
  source 1..4094: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactactacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacaaggtcgaggccgaggtgcagatcgaccggctgatcaccggccgcctccagagcctgcagacctacgtgacccagcagctgatccgggcggccgagatccgcgccagcgccaacctcgccgcgaccaagatgtccgagtgcgtcctgggccagagcaagcgggtggacttctgcgggaagggctaccacctgatgtccttcccccagagcgccccgcacggggtggtcttcctccacgtgacgtacgtccccgcccaggagaagaacttcaccaccgcccccgcgatctgccacgacggcaaggcccacttcccccgcgagggggtgttcgtgtccaacggcacccactggttcgtcacgcagcggaacttctacgagccgcagatcatcaccaccgacaacaccttcgtgagcggcaactgcgacgtggtcatcgggatcgtgaacaacacggtgtacgaccccctgcagcccgagctggactccttcaaggaggagctcgacaagtacttcaagaaccacaccagccccgacgtcgacctgggcgacatctccgggatcaacgccagcgtggtgaacatccagaaggagatcgaccgcctgaacgaggtcgccaagaacctcaacgagtccctgatcgacctgcaggagctcggcaagtacgagcagtacatcaagtggccgtggtacatctggctgggcttcatcgccgggctgatcgcgatcgtgatggtgaccatcatgctctgctgcatgaccagctgctgctcctgcctgaagggctgctgcagctgcgggtcctgctgcaagttcgacgaggacgacagcgagcccgtcctgaagggcgtgaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12331 - RNA, 4094 nt, synthetic construct
  misc_feature 1..4094: note = SARS-CoV-2/USA/UT-00033/2020__EPI_ISL_417976 spike protein mRNA gc (1-1273)
  source 1..4094: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggcctgaccgcgggcgccgccgcctactacgtggggtacctgcagccccgcaccttcctcctgaagtacaacgagaacggcaccatcacggacgcggtcgactgcgccctggaccccctcagcgagaccaagtgcaccctgaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctctacaactccgccagcttctccacgttcaagtgctacggcgtcagccccaccaagctgaacgacctgtgcttcaccaacgtgtacgccgactccttcgtgatccgcggggacgaggtccggcagatcgcccccggccagaccgggaagatcgccgactacaactacaagctcccggacgacttcacgggctgcgtgatcgcgtggaacagcaacaacctggactccaaggtcgggggcaactacaactacctgtaccgcctcttccgcaagagcaacctgaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctcagcttcgagctgctgcacgcccccgccacggtgtgcggccccaagaagtccaccaacctcgtcaagaacaagtgcgtgaacttcaacttcaacggcctgaccgggaccggcgtgctgaccgagagcaacaagaagttcctgccgttccagcagttcgggcgcgacatcgccgacacgaccgacgcggtccgcgacccccagaccctcgagatcctggacatcaccccctgcagcttcggcggggtgtccgtgatcacgccgggcaccaacaccagcaaccaggtcgccgtgctgtaccagggcgtgaactgcaccgaggtccccgtggccatccacgccgaccagctcacgcccacctggcgggtgtactccaccgggagcaacgtcttccagacccgcgccggctgcctgatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctccccgtgagcatgaccaagacgagcgtcgactgcaccatgtacatctgcggcgactccaccgagtgcagcaacctgctgctccagtacgggtccttctgcacccagctgaaccgcgcgctgacgggcatcgccgtggagcaggacaagaacacccaggaggtgttcgcccaggtcaagcagatctacaagacgcccccgatcaaggacttcgggggcttcaacttcagccagatcctccccgacccctccaagcccagcaagcggtccttcatcgaggacctgctgttcaacaaggtgaccctcgccgacgccggcttcatcaagcagtacggggactgcctgggcgacatcgcggcccgcgacctgatctgcgcccagaagttcaacgggctcaccgtgctgccgcccctgctcaccgacgagatgatcgcccagtacaccagcgccctgctggcgggcaccatcacgtccgggtggaccttcggcgccggcgccgccctccagatccccttcgcgatgcagatggcctaccggttcaacgggatcggcgtcacccagaacgtgctgtacgagaaccagaagctgatcgccaaccagttcaacagcgccatcgggaagatccaggactccctcagctccaccgccagcgcgctgggcaagctgcaggacgtggtcaaccagaacgcccaggccctcaacacgctggtgaagcagctgtccagcaacttcggggccatctccagcgtgctcaacgacatcctgtcccgcctggacaaggtcgaggccgaggtgcagatcgaccggctcatcaccggccgcctgcagagcctgcagacctacgtgacccagcagctcatccgggcggccgagatccgcgccagcgccaacctggccgcgaccaagatgtccgagtgcgtcctgggccagagcaagcgggtggacttctgcgggaagggctaccacctcatgtccttcccccagagcgccccgcacggggtggtcttcctgcacgtgacgtacgtccccgcccaggagaagaacttcaccaccgcccccgcgatctgccacgacggcaaggcccacttcccccgcgagggggtgttcgtgtccaacggcacccactggttcgtcacgcagcggaacttctacgagccgcagatcatcaccaccgacaacaccttcgtgagcggcaactgcgacgtggtcatcgggatcgtgaacaacacggtgtacgaccccctgcagcccgagctcgactccttcaaggaggagctggacaagtacttcaagaaccacaccagccccgacgtcgacctgggcgacatctccgggatcaacgccagcgtggtgaacatccagaaggagatcgaccgcctcaacgaggtcgccaagaacctgaacgagtccctgatcgacctccaggagctgggcaagtacgagcagtacatcaagtggccgtggtacatctggctgggcttcatcgccgggctcatcgcgatcgtgatggtgaccatcatgctgtgctgcatgaccagctgctgctcctgcctgaagggctgctgcagctgcgggtcctgctgcaagttcgacgaggacgacagcgagcccgtcctcaagggcgtgaagctgcactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12332 - RNA, 4094 nt, synthetic construct
  misc_feature 1..4094: note = SARS-CoV-2/USA/WI-13/2020__EPI_ISL_417516 spike protein mRNA gc (1-1273)
  source 1..4094: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgctgcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctctacaactccgccagcttctccacgttcaagtgctacggcgtcagccccaccaagctgaacgacctgtgcttcaccaacgtgtacgccgactccttcgtgatccgcggggacgaggtccggcagatcgcccccggccagaccgggaagatcgccgactacaactacaagctcccggacgacttcacgggctgcgtgatcgcgtggaacagcaacaacctggactccaaggtcgggggcaactacaactacctgtaccgcctcttccgcaagagcaacctgaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctcagcttcgagctgctgcacgcccccgccacggtgtgcggccccaagaagtccaccaacctcgtcaagaacaagtgcgtgaacttcaacttcaacggcctgaccgggaccggcgtgctgaccgagagcaacaagaagttcctgccgttccagcagttcgggcgcgacatcgccgacacgaccgacgcggtccgcgacccccagaccctcgagatcctggacatcaccccctgcagcttcggcggggtgtccgtgatcacgccgggcaccaacaccagcaaccaggtcgccgtgctgtaccagggcgtgaactgcaccgaggtccccgtggccatccacgccgaccagctcacgcccacctggcgggtgtactccaccgggagcaacgtcttccagacccgcgccggctgcctgatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctccccgtgagcatgaccaagacgagcgtcgactgcaccatgtacatctgcggcgactccaccgagtgcagcaacctgctgctccagtacgggtccttctgcacccagctgaaccgcgcgctgacgggcatcgccgtggagcaggacaagaacacccaggaggtgttcgcccaggtcaagcagatctacaagacgcccccgatcaaggacttcgggggcttcaacttcagccagatcctccccgacccctccaagcccagcaagcggtccttcatcgaggacctgctgttcaacaaggtgaccctcgccgacgccggcttcatcaagcagtacggggactgcctgggcgacatcgcggcccgcgacctgatctgcgcccagaagttcaacgggctcaccgtgctgccgcccctgctcaccgacgagatgatcgcccagtacaccagcgccctgctggcgggcaccatcacgtccgggtggaccttcggcgccggcgccgccctccagatccccttcgcgatgcagatggcctaccggttcaacgggatcggcgtcacccagaacgtgctgtacgagaaccagaagctgatcgccaaccagttcaacagcgccatcgggaagatccaggactccctcagctccaccgccagcgcgctgggcaagctgcaggacgtggtcaaccagaacgcccaggccctcaacacgctggtgaagcagctgtccagcaacttcggggccatctccagcgtgctcaacgacatcctgtcccgcctggacaaggtcgaggccgaggtgcagatcgaccggctcatcaccggccgcctgcagagcctgcagacctacgtgacccagcagctcatccgggcggccgagatccgcgccagcgccaacctggccgcgaccaagatgtccgagtgcgtcctgggccagagcaagcgggtggacttctgcgggaagggctaccacctcatgtccttcccccagagcgccccgcacggggtggtcttcctgcacgtgacgtacgtccccgcccaggagaagaacttcaccaccgcccccgcgatctgccacgacggcaaggcccacttcccccgcgagggggtgttcgtgtccaacggcacccactggttcgtcacgcagcggaacttctacgagccgcagatcatcaccaccgacaacaccttcgtgagcggcaactgcgacgtggtcatcgggatcgtgaacaacacggtgtacgaccccctgcagcccgagctcgactccttcaaggaggagctggacaagtacttcaagaaccacaccagccccgacgtcgacctgggcgacatctccgggatcaacgccagcgtggtgaacatccagaaggagatcgaccgcctcaacgaggtcgccaagaacctgaacgagtccctgatcgacctccaggagctgggcaagtacgagcagtacatcaagtggccgtggtacatctggctgggcttcatcgccgggctcatcgcgatcgtgatggtgaccatcatgctgtgctgcatgaccagctgctgctcctgcctgaagggctgctgcagctgcgggtcctgctgcaagttcgacgaggacgacagcgagcccgtcctcaagggcgtgaagctgcactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12333 - RNA, 4091 nt, synthetic construct
  misc_feature 1..4091: note = SARS-CoV-2/India/1-27/2020__EPI_ISL_413522 spike protein mRNA gc (1-1272)
  source 1..4091: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtcatccagatcgcccccggccagaccgggaagatcgccgactacaactacaagctgccggacgacttcacgggctgcgtgatcgcgtggaacagcaacaacctcgactccaaggtcgggggcaactacaactacctgtaccggctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgcgtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgggacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgcgtgtactccaccggcagcaacgtcttccagacccgggccgggtgcctcatcggcgcggagcacgtgaacaactcctacgagtgcgacatccccatcggggccggcatctgcgccagctaccagacgcagaccaactccccgcgccgggcccgcagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgggcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcgctccttcatcgaggacctcctgttcaacaaggtgaccctggccgacgccggcttcatcaagcagtacggcgactgcctcggggacatcgcggcccgggacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccgcttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccggctggacaaggtcgaggccgaggtgcagatcgaccgcctgatcaccgggcggctccagagcctgcagacctacgtgacccagcagctgatccgcgcggccgagatccgggccagcgccaacctcgccgcgaccaagatgtccgagtgcgtcctgggccagagcaagcgcgtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgggagggcgtgttcgtgtccaacgggacccactggttcgtcacgcagcgcaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccggctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12334 - RNA, 4076 nt, synthetic construct
  misc_feature 1..4076: note = SARS-CoV-2/pangolin/Guangxi/P4L/2017__EPI_ISL_410538 spike protein mRNA gc (1-1267)
  source 1..4076: mol_type = other RNA
aggagagtcccgcagtcggcgtccagcggctctgcttgttcgtgtgtgtgtcgttgcaggccttattcaagcttaccatgttcgtgttcctgttcgtcctccccctggtgagctcccagtgcgtgaacctgaccacccgcacgggcatcccgcccgggtacaccaacagctccacccggggcgtctactaccccgacaaggtgttccgcagctccatcctccacctgacccaggacctgttcctccccttcttcagcaacgtgacgtggttcaacaccatcaactaccagggcgggttcaagaagttcgacaacccggtcctgcccttcaacgacggggtgtacttcgcctccaccgagaagtccaacatcatccggggctggatcttcggcaccacgctggacgcccgcacccagagcctcctgatcgtgaacaacgcgaccaacgtcgtgatcaaggtgtgcgagttccagttctgcaccgaccccttcctgggggtctactaccacaacaacaacaagacgtgggtggagaacgagttccgggtgtacagctccgccaacaactgcaccttcgagtacatcagccagcccttcctcatggacctggagggcaagcaggggaacttcaagaacctgcgcgagttcgtcttcaagaacgtggacggctacttcaagatctactccaagcacaccccgatcgacctcgtgcgggacctgccccgcgggttcgccgccctggagcccctcgtcgacctgcccatcggcatcaacatcacccggttccagacgctgctcgccctgcaccgcagctacctgaccccgggcaacctcgagtccgggtggaccaccggcgcggccgcctactacgtggggtacctgcagcagcggacgttcctgctcagctacaaccagaacggcaccatcaccgacgccgtggactgctccctggaccccctgagcgagaccaagtgcacgctcaagtccctgaccgtcgagaagggcatctaccagaccagcaacttccgcgtgcagcccaccatcagcatcgtgcggttccccaacatcacgaacctgtgcccgttcggggaggtcttcaacgcgtccaagttcgccagcgtgtacgcctggaaccgcaagcggatctccaactgcgtcgccgactacagcgtgctctacaactccaccagcttctccaccttcaagtgctacggcgtgagccccaccaagctgaacgacctgtgcttcacgaacgtctacgccgactccttcgtggtgaagggggacgaggtccgccagatcgcgcccggccagaccggggtgatcgccgactacaactacaagctccccgacgacttcaccggctgcgtgatcgcctggaacagcgtcaagcaggacgccctgaccggcgggaactacggctacctgtaccgcctcttccggaagtccaagctgaagccgttcgagcgggacatcagcacggagatctaccaggccgggtccaccccctgcaacggccaggtggggctgaactgctactaccccctcgagcgctacggcttccaccccaccaccggcgtgaactaccagccgttccgggtcgtggtgctgagcttcgagctgctcaacgggcccgcgaccgtctgcggccccaagctgtccacgaccctggtgaaggacaagtgcgtgaacttcaacttcaacgggctgaccggcaccggggtcctcacgaccagcaagaagcagttcctgcccttccagcagttcggccgcgacatctccgacaccaccgacgccgtgcgcgacccgcagacgctggagatcctcgacatcaccccctgcagcttcggcggggtgtccgtcatcacccccggcaccaacacgagcaaccaggtggccgtgctgtaccaggacgtcaactgcaccgaggtgccgatggccatccacgccgagcagctgacccccgcgtggcgggtgtacagcgccggggccaacgtcttccagacccgcgccggctgcctcgtgggcgccgagcacgtgaacaactcctacgagtgcgacatccccgtcggggcgggcatctgcgccagctaccactccatgagctccctgcggagcgtgaaccagcgctccatcatcgcctacacgatgagcctgggggccgagaactccgtggcgtacagcaacaactccatcgccatccccaccaacttcaccatcagcgtcaccacggagatcctcccggtgtccatgaccaagaccagcgtggactgcaccatgtacatctgcggcgactccatcgagtgcagcaacctgctgctccagtacgggtccttctgcacgcagctgaaccgggccctgaccggcatcgccgtcgagcaggacaagaacacccaggaggtgttcgcccaggtgaagcagatctacaagaccccgcccatcaaggacttcggcgggttcaacttcagccagatcctccccgaccccagcaagccctccaagcgcagcttcatcgaggacctgctgttcaacaaggtcacgctcgcggacgccggcttcatcaagcagtacggggactgcctgggcgacatcgccgcccgggacctgatctgcgcccagaagttcaacgggctcaccgtgctgccgcccctgctcaccgacgagatgatcgcgcagtacacctccgccctgctggccggcacgatcaccagcggctggaccttcggggccggcgccgcgctccagatccccttcgccatgcagatggcctaccgcttcaacgggatcggcgtgacccagaacgtcctgtacgagaaccagaagctgatcgccaaccagttcaactccgcgatcgggaagatccaggacagcctctccagcacggcctccgccctgggcaagctgcaggacgtggtgaaccagaacgcccaggccctcaacaccctggtcaagcagctgagctccaacttcggcgcgatcagctccgtgctcaacgacatcctgagccggctggacaaggtggaggccgaggtccagatcgaccgcctcatcaccgggcggctgcagtccctgcagacctacgtgacccagcagctcatccgcgccgccgagatccgggccagcgcgaacctggccgccacgaagatgtccgagtgcgtgctgggccagagcaagcgcgtcgacttctgcgggaagggctaccacctcatgtccttcccccagagcgcgccccacggggtggtcttcctgcacgtgacctacgtgcccgcccaggagaagaacttcaccaccgccccggccatctgccacgagggcaaggcccacttcccccgggagggcgtcttcgtgagcaacgggacgcactggttcatcacccagcgcaacttctacgagccccagatcatcaccaccgacaacacgttcgtgtccggcagctgcgacgtcgtgatcgggatcgtgaacaacaccgtctacgaccccctgcagccggagctcgactccttcaaggaggagctggacaagtacttcaagaaccacaccagccccgacgtggacctgggcgacatctccggcatcaacgccagcgtggtcaacatccagaaggagatcgaccggctcaacgaggtggcgaagaacctgaacgagtcccccatcgacctgcaggagctcgggaagtacgagcagtacatcaagtggccctggtacatctggctgggcttcatcgccgggctgatcgccatcatcatggtgaccatcatgctctgctgcatgacgagctgctgctcctgcctgaagggctgctgcagctgcgggtcctgctgcaagttcgacgaggacgacagcgagccggtcctgaagggcgtgaagctccactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12335 - RNA, 4076 nt, synthetic construct
  misc_feature 1..4076: note = SARS-CoV-2/pangolin/Guangxi/P5L/2017__EPI_ISL_410540 spike protein mRNA gc (1-1267)
  source 1..4076: mol_type = other RNA
aggagagtcccgcagtcggcgtccagcggctctgcttgttcgtgtgtgtgtcgttgcaggccttattcaagcttaccatgttcgtgttcctgttcgtcctccccctggtgagctcccagtgcgtgaacctgaccacccgcacgggcatcccgcccgggtacaccaacagctccacccggggcgtctactaccccgacaaggtgttccgcagctccatcctccacctgacccaggacctgttcctccccttcttcagcaacgtgacgtggttcaacaccatcaactaccagggcgggttcaagaagttcgacaacccggtcctgcccttcaacgacggggtgtacttcgcctccaccgagaagtccaacatcatccggggctggatcttcggcaccacgctggacgcccgcacccagagcctcctgatcgtgaacaacgcgaccaacgtcgtgatcaaggtgtgcgagttccagttctgcaccgaccccttcctgggggtctactaccacaacaacaacaagacgtgggtggagaacgagttccgggtgtacagctccgccaacaactgcaccttcgagtacatcagccagcccttcctcatggacctggagggcaagcaggggaacttcaagaacctgcgcgagttcgtcttcaagaacgtggacggctacttcaagatctactccaagcacaccccgatcgacctcgtgcgggacctgccccgcgggttcgccgccctggagcccctcgtcgacctgcccatcggcatcaacatcacccggttccagacgctgctcgccctgcaccgcagctacctgaccccgggcaagctcgagtccgggtggaccaccggcgcggccgcctactacgtggggtacctgcagcagcggacgttcctgctcagctacaaccagaacggcaccatcaccgacgccgtggactgctccctggaccccctgagcgagaccaagtgcacgctcaagtccctgaccgtcgagaagggcatctaccagaccagcaacttccgcgtgcagcccaccatcagcatcgtgcggttccccaacatcacgaacctgtgcccgttcggggaggtcttcaacgcgtccaagttcgccagcgtgtacgcctggaaccgcaagcggatctccaactgcgtcgccgactacagcgtgctctacaactccaccagcttctccaccttcaagtgctacggcgtgagccccaccaagctgaacgacctgtgcttcacgaacgtctacgccgactccttcgtggtgaagggggacgaggtccgccagatcgcgcccggccagaccggggtgatcgccgactacaactacaagctccccgacgacttcaccggctgcgtgatcgcctggaacagcgtcaagcaggacgccctgaccggcgggaactacggctacctgtaccgcctcttccggaagtccaagctgaagccgttcgagcgggacatcagcacggagatctaccaggccgggtccaccccctgcaacggccaggtggggctgaactgctactaccccctcgagcgctacggcttccaccccaccaccggcgtgaactaccagccgttccgggtcgtggtgctgagcttcgagctgctcaacgggcccgcgaccgtctgcggccccaagctgtccacgaccctggtgaaggacaagtgcgtgaacttcaacttcaacgggctgaccggcaccggggtcctcacgaccagcaagaagcagttcctgcccttccagcagttcggccgcgacatctccgacaccaccgacgccgtgcgcgacccgcagacgctggagatcctcgacatcaccccctgcagcttcggcggggtgtccgtcatcacccccggcaccaacacgagcaaccaggtggccgtgctgtaccaggacgtcaactgcaccgaggtgccgatggccatccacgccgagcagctgacccccgcgtggcgggtgtacagcgccggggccaacgtcttccagacccgcgccggctgcctcgtgggcgccgagcacgtgaacaactcctacgagtgcgacatccccgtcggggcgggcatctgcgccagctaccactccatgagctccttccggagcgtgaaccagcgctccatcatcgcctacacgatgagcctgggggccgagaactccgtggcgtacagcaacaactccatcgccatccccaccaacttcaccatcagcgtcaccacggagatcctgccggtgtccatgaccaagaccagcgtggactgcaccatgtacatctgcggcgactccatcgagtgcagcaacctcctgctgcagtacgggtccttctgcacgcagctcaaccgggccctgaccggcatcgccgtcgagcaggacaagaacacccaggaggtgttcgcccaggtgaagcagatctacaagaccccgcccatcaaggacttcggcgggttcaacttcagccagatcctgcccgaccccagcaagccctccaagcgcagcttcatcgaggacctcctgttcaacaaggtcacgctggcggacgccggcttcatcaagcagtacggggactgcctcggcgacatcgccgcccgggacctgatctgcgcccagaagttcaacgggctgaccgtgctcccgcccctgctgaccgacgagatgatcgcgcagtacacctccgccctcctggccggcacgatcaccagcggctggaccttcggggccggcgccgcgctgcagatccccttcgccatgcagatggcctaccgcttcaacgggatcggcgtgacccagaacgtcctctacgagaaccagaagctgatcgccaaccagttcaactccgcgatcgggaagatccaggacagcctgtccagcacggcctccgccctcggcaagctgcaggacgtggtgaaccagaacgcccaggccctgaacaccctcgtcaagcagctgagctccaacttcggcgcgatcagctccgtgctgaacgacatcctcagccggctggacaaggtggaggccgaggtccagatcgaccgcctgatcaccgggcggctccagtccctgcagacctacgtgacccagcagctgatccgcgccgccgagatccgggccagcgcgaacctcgccgccacgaagatgtccgagtgcgtgctgggccagagcaagcgcgtcgacttctgcgggaagggctaccacctgatgtccttcccccagagcgcgccccacggggtggtcttcctccacgtgacctacgtgcccgcccaggagaagaacttcaccaccgccccggccatctgccacgagggcaaggcccacttcccccgggagggcgtcttcgtgagcaacgggacgcactggttcatcacccagcgcaacttctacgagccccagatcatcaccaccgacaacacgttcgtgtccggcagctgcgacgtcgtgatcgggatcgtgaacaacaccgtctacgaccccctgcagccggagctggactccttcaaggaggagctcgacaagtacttcaagaaccacaccagccccgacgtggacctgggcgacatctccggcatcaacgccagcgtggtcaacatccagaaggagatcgaccggctgaacgaggtggcgaagaacctcaacgagtccctgatcgacctgcaggagctcgggaagtacgagcagtacatcaagtggccctggtacatctggctgggcttcatcgccgggctgatcgccatcatcatggtgaccatcatgctctgctgcatgacgagctgctgctcctgcctgaagggctgctgcagctgcgggtcctgctgcaagttcgacgaggacgacagcgagcccgtcctgaagggcgtgaagctccactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12336 - RNA, 4076 nt, synthetic construct
  misc_feature 1..4076: note = SARS-CoV-2/pangolin/Guangxi/P5E/2017__EPI_ISL_410541 spike protein mRNA gc (1-1267)
  source 1..4076: mol_type = other RNA
aggagagtcccgcagtcggcgtccagcggctctgcttgttcgtgtgtgtgtcgttgcaggccttattcaagcttaccatgttcgtgttcctgttcgtcctccccctggtgagctcccagtgcgtgaacctgaccacccgcacgggcatcccgcccgggtacaccaacagctccacccggggcgtctactaccccgacaaggtgttccgcagctccatcctccacctgacccaggacctgttcctccccttcttcagcaacgtgacgtggttcaacaccatcacctaccagggcgggtccaagaagttcgacaacccggtcctgcccttcaacgacggggtgtacttcgccagcaccgagaagtccaacatcatccggggctggatcttcggcacgaccctggacgcccgcacccagagcctcctgatcgtgaacaacgcgaccaacgtcgtgatcaaggtgtgcgagttccagttctgcacggaccccttcctgggggtctactaccacaacaacaacaagacctgggtggagaacgagttccgggtgtactccagcgccaacaactgcaccttcgagtacatctcccagcccttcctcatggacctggagggcaagcaggggaacttcaagaacctgcgcgagttcgtcttcaagaacgtggacggctacttcaagatctacagcaagcacaccccgatcgacctcgtgcgggacctgccccgcgggttcgccgccctggagcccctcgtcgacctgcccatcggcatcaacatcacgcggttccagaccctgctcgccctgcaccgctcctacctgaccccgggcaagctcgagagcgggtggaccacgggcgcggccgcctactacgtggggtacctgcagcagcggaccttcctgctctcctacaaccagaacggcaccatcaccgacgccgtggactgcagcctggaccccctgtccgagacgaagtgcaccctcaagagcctgaccgtcgagaagggcatctaccagaccagcaacttccgcgtgcagcccacgatctccatcgtgcggttccccaacatcaccaacctgtgcccgttcggggaggtcttcaacgcgagcaagttcgcctccgtgtacgcctggaaccgcaagcggatcagcaactgcgtcgccgactactccgtgctctacaacagcacctccttcagcaccttcaagtgctacggcgtgtcccccacgaagctgaacgacctgtgcttcaccaacgtctacgccgacagcttcgtggtgaagggggacgaggtccgccagatcgcgcccggccagaccggggtgatcgccgactacaactacaagctccccgacgacttcaccggctgcgtgatcgcctggaactccgtcaagcaggacgccctgacgggcgacaactacgggtacctgtaccggctgttccgcaagagcaagctcaagccgttcgagcgggacatctccaccgagatctaccaggccggcagcaccccctgcaacggccaggtggggctgaactgctactaccccctcgagcgctacgggttccaccccaccaccggcgtgaactaccagccgttccgggtcgtggtgctgtccttcgagctgctcaacggccccgcgacggtctgcgggcccaagctgagcaccaccctggtgaaggacaagtgcgtgaacttcaacttcaacggcctgaccgggacgggcgtcctcaccacctccaagaagcagttcctgcccttccagcagttcgggcgcgacatcagcgacaccacggacgccgtgcgcgacccgcagaccctggagatcctcgacatcaccccctgctccttcggcggcgtgagcgtcatcacccccgggacgaacaccagcaaccaggtggccgtgctgtaccaggacgtcaactgcaccgaggtgccgatggccatccacgccgagcagctgacccccgcgtggcgggtgtactccgccggcgccaacgtcttccagacgcgcgccgggtgcctcgtgggcgccgagcacgtgaacaacagctacgagtgcgacatccccgtcggcgcggggatctgcgcctcctaccacagcatgtccagcttccggtccgtgaaccagcgcagcatcatcgcctacaccatgtccctgggcgccgagaacagcgtggcgtactccaacaacagcatcgccatccccaccaacttcaccatctccgtcacgaccgagatcctgccggtgagcatgaccaagacctccgtggactgcacgatgtacatctgcggggacagcatcgagtgctccaacctcctgctgcagtacggcagcttctgcacccagctcaaccgggccctgaccgggatcgccgtcgagcaggacaagaacacccaggaggtgttcgcccaggtgaagcagatctacaagacgccgcccatcaaggacttcggcggcttcaacttcagccagatcctgcccgacccctccaagcccagcaagcgctccttcatcgaggacctcctgttcaacaaggtcaccctggcggacgccgggttcatcaagcagtacggcgactgcctcggggacatcgccgcccgggacctgatctgcgcccagaagttcaacggcctgaccgtgctcccgcccctgctgaccgacgagatgatcgcgcagtacacgagcgccctcctggccgggaccatcacctccggctggaccttcggcgccggggccgcgctgcagatccccttcgccatgcagatggcctaccgcttcaacggcatcggggtgacgcagaacgtcctctacgagaaccagaagctgatcgccaaccagttcaacagcgcgatcggcaagatccaggactccctgagctccaccgccagcgccctcgggaagctgcaggacgtggtgaaccagaacgcccaggccctgaacaccctcgtcaagcagctgtccagcaacttcggcgcgatctccagcgtgctgaacgacatcctctcccggctggacaaggtggaggccgaggtccagatcgaccgcctgatcaccggccggctccagagcctgcagacctacgtgacgcagcagctgatccgcgccgccgagatccgggcctccgcgaacctcgccgccaccaagatgagcgagtgcgtgctggggcagtccaagcgcgtcgacttctgcggcaaggggtaccacctgatgagcttcccccagagcgcgccccacggcgtggtcttcctccacgtgacctacgtgcccgcccaggagaagaacttcaccacggccccggccatctgccacgaggggaaggcccacttcccccgggagggcgtcttcgtgtccaacggcacccactggttcatcacccagcgcaacttctacgagccccagatcatcaccacggacaacaccttcgtgagcgggtcctgcgacgtcgtgatcggcatcgtgaacaacaccgtctacgaccccctgcagccggagctggacagcttcaaggaggagctcgacaagtacttcaagaaccacacctcccccgacgtggacctgggggacatcagcggcatcaacgcctccgtggtcaacatccagaaggagatcgaccggctgaacgaggtggcgaagaacctcaacgagagcctgatcgacctgcaggagctcggcaagtacgagcagtacatcaagtggccctggtacatctggctggggttcatcgccggcctgatcgccatcatcatggtgacgatcatgctctgctgcatgacctcctgctgcagctgcctgaaggggtgctgctcctgcggcagctgctgcaagttcgacgaggacgactccgagcccgtcctgaagggggtgaagctccactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12337 - RNA, 4070 nt, synthetic construct
  misc_feature 1..4070: note = SARS-CoV-2/pangolin/Guangxi/P1E/2017__EPI_ISL_410539 spike protein mRNA gc (1-1265)
  source 1..4070: mol_type = other RNA
aggagagtcccgcagtcggcgtccagcggctctgcttgttcgtgtgtgtgtcgttgcaggccttattcaagcttaccatgttcgtgttcctgttcgtcctccccctggtgagctcccagtgcgtgaacctgaccacccgcacgggcatccagccggggtacaccaacagctccacccggggcgtctactaccccgacaaggtgttccgcagctccatcctccacctgacccaggacctgttcctccccttcttcagcaacgtgacgtggttcaacaccatcaactaccagggcgggttcaagaagttcgacaaccccgtcctgccgttcaacgacggggtgtacttcgcctccaccgagaagtccaacatcatccggggctggatcttcggcaccacgctggacgcccgcacccagagcctcctgatcgtgaacaacgcgaccaacgtcgtgatcaaggtgtgcgagttccagttctgcaccgaccccttcctgggggtctactaccacaacaacaacaagacgtgggtggagaacgagttccgggtgtacagctccgccaacaactgcaccttcgagtacatcagccagcccttcctcatggacctggagggcaagcaggggaacttcaagaacctgcgcgagttcgtcttcaagaacgtggacggctacttcaagatctactccaagcacacccccatcgacctcgtgcgggacctgccgcgcgggttcgccgccctggagcccctcgtcgacctgcccatcggcatcaacatcacccggttccagacgctgctcgccctgcaccgcagctacctgacccccggcaagctcgagtccgggtggaccaccggcgcggccgcctactacgtggggtacctgcagcagcggacgttcctgctcagctacaaccagaacggcaccatcaccgacgccgtggactgctccctggacccgctgagcgagaccaagtgcacgctcaagtccctgaccgtcgagaagggcatctaccagaccagcaacttccgcgtgcagcccaccatcagcatcgtgcggttccccaacatcacgaacctgtgccccttcggggaggtcttcaacgcgtccaagttcgccagcgtgtacgcctggaaccgcaagcggatctccaactgcgtcgccgactacagcgtgctctacaactccaccagcttctccaccttcaagtgctacggcgtgagcccgaccaagctgaacgacctgtgcttcacgaacgtctacgccgactccttcgtggtgaagggggacgaggtccgccagatcgcgcccggccagaccggggtgatcgccgactacaactacaagctccccgacgacttcaccggctgcgtgatcgcctggaacagcgtcaagcaggacgccctgaccggcgggaactacctgtaccgcctcttccggaagtccaagctgaagcccttcgagcgggacatcagcacggagatctaccaggccggctccaccccgtgcaacggccaggtggggctgaactgctactaccccctcgagcgctacgggttccaccccaccaccggcgtgaactaccagcccttccgggtcgtggtgctgagcttcgagctgctcaacggcccggcgaccgtctgcgggcccaagctgtccacgaccctggtgaaggacaagtgcgtgaacttcaacttcaacggcctgaccgggaccggcgtcctcacgaccagcaagaagcagttcctgcccttccagcagttcgggcgcgacatctccgacaccaccgacgccgtgcgcgacccccagacgctggagatcctcgacatcaccccgtgcagcttcggcggcgtgtccgtcatcacccccgggaccaacacgagcaaccaggtggccgtgctgtaccaggacgtcaactgcaccgaggtgcccatggccatccacgccgagcagctgaccccggcgtggcgggtgtacagcgccggcgccaacgtcttccagacccgcgccgggtgcctcgtgggcgccgagcacgtgaacaactcctacgagtgcgacatccccgtcggcgcggggatctgcgccagctaccactccatgagctccctgcggagcgtgaaccagcgctccatcatcgcctacacgatgagcctgggcgccgagaactccgtggcgtacagcaacaactccatcgccatccccaccaacttcaccatcagcgtcaccacggagatcctccccgtgtccatgaccaagaccagcgtggactgcaccatgtacatctgcggggactccatcgagtgcagcaacctgctgctccagtacggctccttctgcacgcagctgaaccgggccctgaccgggatcgccgtcgagcaggacaagaacacccaggaggtgttcgcccaggtgaagcagatctacaagaccccgcccatcaaggacttcggcggcttcaacttcagccagatcctccccgaccccagcaagccgtccaagcgcagcttcatcgaggacctgctgttcaacaaggtcacgctcgcggacgccgggttcatcaagcagtacggcgactgcctgggggacatcgccgcccgggacctgatctgcgcccagaagttcaacggcctcaccgtgctgccgcccctgctcaccgacgagatgatcgcgcagtacacctccgccctgctggccgggacgatcaccagcggctggaccttcggcgccggggccgcgctccagatccccttcgccatgcagatggcctaccgcttcaacggcatcggggtgacccagaacgtcctgtacgagaaccagaagctgatcgccaaccagttcaactccgcgatcggcaagatccaggacagcctctccagcacggcctccgccctggggaagctgcaggacgtggtgaaccagaacgcccaggccctcaacaccctggtcaagcagctgagctccaacttcggcgcgatcagctccgtgctcaacgacatcctgagccggctggacaaggtggaggccgaggtccagatcgaccgcctcatcaccggccggctgcagtccctgcagacctacgtgacccagcagctcatccgcgccgccgagatccgggccagcgcgaacctggccgccacgaagatgtccgagtgcgtgctggggcagagcaagcgcgtcgacttctgcggcaaggggtaccacctcatgtccttcccccagagcgcgccccacggcgtggtcttcctgcacgtgacctacgtgcccgcccaggagaagaacttcaccaccgcccccgccatctgccacgaggggaaggcccacttcccgcgggagggcgtcttcgtgagcaacggcacgcactggttcatcacccagcgcaacttctacgagccccagatcatcaccaccgacaacacgttcgtgtccgggagctgcgacgtcgtgatcggcatcgtgaacaacaccgtctacgaccccctgcagcccgagctcgactccttcaaggaggagctggacaagtacttcaagaaccacaccagcccggacgtggacctgggggacatctccggcatcaacgccagcgtggtcaacatccagaaggagatcgaccggctcaacgaggtggcgaagaacctgaacgagtccctgatcgacctccaggagctgggcaagtacgagcagtacatcaagtggccctggtacatctggctggggttcatcgccggcctcatcgccatcatcatggtgaccatcatgctgtgctgcatgacgagctgctgctcctgcctgaaggggtgctgcagctgcggctcctgctgcaagttcgacgaggacgacagcgagcccgtcctcaagggggtgaagctgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12338 - RNA, 4094 nt, synthetic construct; identical to SEQ ID NO: 149
  misc_feature 1..4094: note = SARS-CoV-2/Wuhan/WIV05/2019__EPI_ISL_402128 spike protein mRNA gc (1-1273)(K986P_V987P) R9487, R9491, R9709, R10159, R10160
  source 1..4094: mol_type = other RNA

SEQ ID NO: 12339 - RNA, 4094 nt, synthetic construct
  misc_feature 1..4094: note = SARS-CoV-2/Wuhan/WIV05/2019__EPI_ISL_402128 spike protein mRNA gc (1-1273)(K986P_V987P_T887WN_A1020W)
  source 1..4094: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggtggttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgctggagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12340 - RNA, 4094 nt, synthetic construct
  misc_feature 1..4094: note = SARS-CoV-2/Wuhan/WIV05/2019__EPI_ISL_402128 spike protein mRNA gc (1-1273)(K986P_V987P_P1069F)
  source 1..4094: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtcttcgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12341 - RNA, 4094 nt, synthetic construct
  misc_feature 1..4094: note = SARS-CoV-2/Wuhan/WIV05/2019__EPI_ISL_402128 spike protein mRNA gc (1-1273)(K986P_V987P_ H1048Q_H1064N_ H1083N_H1101N)
  source 1..4094: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccagctgatgtccttcccccagagcgccccgcacggcgtggtcttcctcaacgtgacgtacgtccccgcccaggagaagaacttcaccaccgcccccgcgatctgcaacgacgggaaggcccacttcccccgcgagggcgtgttcgtgtccaacgggaccaactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12342 - RNA, 4094 nt, synthetic construct
  misc_feature 1..4094: note = SARS-CoV-2/Wuhan/WIV05/2019__EPI_ISL_402128 spike protein mRNA gc (1-1273)(I712C_T1077C)
  source 1..4094: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagctgcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcacctgcgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa
